United States Patent
Serino et al.

(10) Patent No.: US 8,470,341 B2
(45) Date of Patent: Jun. 25, 2013

(54) ESCHERICHIA COLI IMMUNOGENS WITH IMPROVED SOLUBILITY

(75) Inventors: Laura Serino, Monticiano (IT); Mariagrazia Pizza, Siena (IT); Danilo Gomes Moriel, Siena (IT); Maria Rita Fontana, Siena (IT)

(73) Assignee: Novartis AG, Basel (CH)

( * ) Notice: Subject to any disclaimer, the term of this patent is extended or adjusted under 35 U.S.C. 154(b) by 0 days.

(21) Appl. No.: 12/735,848

(22) PCT Filed: Feb. 23, 2009

(86) PCT No.: PCT/IB2009/000440
§ 371 (c)(1),
(2), (4) Date: Aug. 20, 2010

(87) PCT Pub. No.: WO2009/104092
PCT Pub. Date: Aug. 27, 2009

(65) Prior Publication Data
US 2011/0091492 A1     Apr. 21, 2011

Related U.S. Application Data

(60) Provisional application No. 61/030,902, filed on Feb. 22, 2008.

(30) Foreign Application Priority Data

Jul. 9, 2008   (IT) ............................... MI2008A1249

(51) Int. Cl.
*A61K 39/108* (2006.01)
*C07K 14/00* (2006.01)
*C12N 1/20* (2006.01)

(52) U.S. Cl.
USPC .................... 424/257.1; 424/185.1; 530/350; 435/252.33

(58) Field of Classification Search
None
See application file for complete search history.

(56) References Cited

U.S. PATENT DOCUMENTS 5,998,584 A     12/1999   Baekkeskov et al.

FOREIGN PATENT DOCUMENTS

| JP | 2006-296420 | 11/2006 |
| WO | WO-2006/089264 | 8/2006 |

OTHER PUBLICATIONS

EMBL database accession No. B3I0E4_ECOLX, Sep. 2, 2008.
International Search Report mailed Dec. 18, 2009 for PCT/IB2009/000440 filed Feb. 23, 2009, 4 pages.

*Primary Examiner* — Padma V Baskar
(74) *Attorney, Agent, or Firm* — Morrison & Foerster LLP

(57) ABSTRACT

Variants of the pathogenic *E. coli* 'AcfD precursor' have been identified with increased solubility as compared to the native AcfD protein that raise a substantially similar immune response in a subject as the native AcfD protein.

5 Claims, 17 Drawing Sheets

FIGURE 1A

```
                 10        20        30        40        50        60        70
                  |         |         |         |         |         |         |
SEQID3      MNKKFKYKKSLLAAILSATLLAGCDGGGSGSSSDTPPVDSGTGSLPEVKPDPTPNPEPTPEPTPDPEPTP
SEQID4      MNKKFKYKKSLLAAILSATLLAGCDGGGSGSSSDTPPVDSGTGSLPEVKPDPTPNPEPTPEPTPDPEPTP
SEQID12     MNKKFKYKKSLLAAILSATLLAGCDGGGSGSSSDTPPVDSGTGSLPEVKPDPTPNPEPTPEPTPDPEPTP
SEQID16     MNKKFKYKKSLLAAILSATLLAGCDGGGSGPSSDTPPVDSGTGSLPEVKPDPTPNPEPTPEPTPDPEPTP
SEQID5      MNKKFKYKKSLLAAILSATLLAGCDGGGSGSSSDTPPVDSGTGSLPEVKPDPTPNPEPTPEPTPDPEPTP
SEQID14     MNKKFKYKKSLLAAILSATLLAGCDGGGSGSSSDTPPVDSGTGSLPEVKPDPTPNPEPTPEPTPDPEPTP
SEQID6      MNKKFKYKKSLLAAILSATLLAGCDGGGSGSSSDTPPVDSGTGSLPEVKPDPTPNPEPTPEPTPDPEPTP
SEQID8      MNKKFKYKKSLLAAILSATLLAGCDGGGSGSSSDTPPVDSGTGSLPEVKPDPTPNPEPTPEPTPDPEPTP
SEQID9      MNKKFKYKKSLLAAILSATLLAGCDGGGSGSSSDTPPVDSGTGSLPEVKPDPTPNPEPTPEPTPDPEPTP
SEQID11     MNKKFKYKKSLLAAILSATLLAGCDGGGSGSSSDTPPVDSGTGSLPEVKPDPTPNPEPTPEPTPDPEPTP
SEQID7      MNKKFKYKKSLLAAILSATLLAGCDGGGSGSSSDTPPVDSGTGSLPEVKPDPTPNPEPTPEPTPDPEPTP
SEQID13     MNKKFKYKKSLLAAILSATLLAGCDGGGSGSSSDTPPVDSGTGSLPEVKPDPTPNPEPTPEPTPDPEPTP
SEQID15     MNKKFKYKKSLLAAILSATLLAGCDGGGSGSSSDTPPVDSGTGSLPEVKPDPTPNPEPTPEPTPDPEPTP
SEQID2      MNKKFKYKKSLLAAILSATLLAGCDGGGSGSSSDTPSVDSGSGTLPEVKPDPTPTPEPTPEPTPDPEPTP
SEQID10     MNKKFKYKKSLLAAILSATLLAGCDGGGSGSSSDTPSVDSGSGTLPEVKPDPTPTPEPTPEPTPDPEPTP
            ****************************.***** ****:*:**********.***************
PRIM.CONS.  MNKKFKYKKSLLAAILSATLLAGCDGGGSGSSSDTPPVDSGTGSLPEVKPDPTPNPEPTPEPTPDPEPTP
N-TERM REG  GGGGGGGGGGGGGGGGGGGGGGGGGGGGGGGGGGPPPPPPPPPPPPPPPPPPPPPPPPPPPPPPPPPPPP 80        90       100       110       120       130       140
                  |         |         |         |         |         |         |
SEQID3      EPTPDP--EPTPEPEPEPVPTKTGYLTLGGSQRITG-ATCNGESSDGFTFTPGDKVTCVAGNNTTIATFD
SEQID4      EPTPDP--EPTPEPEPEPVPTKTGYLTLGGSQRITG-ATCNGESSDGFTFTPGDKVTCVAGNNTTIATFD
SEQID12     EPTPDP--EPTPEPEPEPVPTKTGYLTLGGSQRITG-ATCNGESSDGFTFTPGDKVTCVAGNNTTIATFD
SEQID16     DPTPDP--EPTPEPEPEPVPTKTGYLTLGGSQRITG-ATCNGESSDGFTFTPGDKVTCVAGNNTTIATFD
SEQID5      EPIPDP--EPTPEPEPEPVPTKTGYLTLGGSQRVTG-ATCNGESSDGFTFKPGEDVTCVAG-NTTIATFN
SEQID14     EPIPDP--EPTPEPEPEPVPTKTGYLTLGGSQRVTG-ATCNGESSDGFTFKPGEDVTCVAG-NTTIATFN
SEQID6      EPTPDP--EPTPEPEPEPVPTKTGYLTLGGSLRVTGDITCNDESSDGFTFTPGDKVTCVAGNNTTIATFD
SEQID8      EPTPDP--EPTPEPEPEPVPTKTGYLTLGGSLRVTGDITCNDESSDGFTFTPGDKVTCVAGNNTTIATFD
SEQID9      EPTPDP--EPTPEPEPEPVPTKTGYLTLGGSLRVTGDITCNDESSDGFTFTPGDKVTCVAGNNTTIATFD
SEQID11     EPIPDP--EPTPEPEPEPVPTKTGYLTLGGSQRVTG-ATCNGESSDGFTFKPGEDVTCVAG-NTTIATFN
SEQID7      EPTPDP--EPTPEPEPEPVPTKTGYLTLGGSLRVTGDITCNDESSDGFTFTPGDKVTCVAGNNTTIATFD
SEQID13     EPIPDP--EPTPEPEPEPVPTKTGYLTLGGSQRVTG-ATCNGESSDGFTFKPGEDVTCVAG-NTTIATFN
SEQID15     EPIPDP--EPTPEPEPEPVPTKTGYLTLGGSQRVTG-ATCNGESSDGFTFKPGEDVTCVAG-NTTIATFN
SEQID2      DPTPDP--EPTPEPEPEPVPTKTGYLTLGGSQRVTG-ATCNGESSDGFTFTPGNTVSCVVG-STTIATFN
SEQID10     DPTPDPDPEPTPEPEPEPVPTKTGYLTLGGSQRVTG-ATCNGESSDGFTFTPGNTVSCVVG-STTIATFN
            :* ***  ********************** *:**   ***.********.**: *:**.* .******:
PRIM.CONS.  EPTPDPDPEPTPEPEPEPVPTKTGYLTLGGSQRVTGDATCNGESSDGFTFTPGDKVTCVAGNNTTIATFD
N-TERM REG  PPPPPPPPPPPPPPPPPPPPPPPP
```

FIGURE 1B

```
                    150        160        170        180        190        200        210
                     |          |          |          |          |          |          |
SEQID3      TQSEAARSLRAVEKVSFSLEDAQELAASDDKKSNAVSLVTSSNSCPANTEQVCLTFSSVIESKRFDSLYK
SEQID4      TQSEAARSLRAVEKVSFSLEDAQELAASDDKKSNAVSLVTSSNSCPADTEQVCLTFSSVIESKRFDSLYK
SEQID12     TQSEAARSLRAVEKVSFSLEDAQELAASDDKKSNAVSLVTSSNSCPANTEQVCLTFSSVIESKRFDSLYK
SEQID16     TQSEAARSLRAVEKVSFSLEDAQELAASDDKKSNAVSLVTSSNSCPADTEQVCLTFSSVIESKRFDSLYK
SEQID5      TQSEAARSLRAVEKVSFSLEDAQELAGSDDKKSNAVSLVTSSNSCPANTEQVCLTFSSVIESKRFDSLYK
SEQID14     TQSEAARSLRAVEKVSFSLEDAQELAGSDDKKSNAVSLVTSSNSCPANTEQVCLTFSSVIESKRFDSLYK
SEQID6      TQSEAARSLRAVEKVSFSLEDAQELAGSDNKKSNALSLVTSMNSCPANTEQVCLEFSSVIESKRFDSLYK
SEQID8      TQSEAARSLRAVEKVSFSLEDAQELAGSDNKKSNALSLVTSMNSCPANTEQVCLEFSSVIESKRFDSLYK
SEQID9      TQSEAARSLRAVEKVSFSLEDAQELAGSDNKKSNALSLVTSMNSCPANTEQVCLEFSSVIESKRFDSLYK
SEQID11     TQSEAARSLRAVEKVSFSLEDAQELAGSDDKKSNAVSLVTSSNSCPANTEQVCLTFSSVIESKRFDSLYK
SEQID7      TQSEAARSLRAVEKVSFSLEDAQELAGSDNKKSNALSLVTSMNSCPANTEQVCLEFSSVIESKRFDSLYK
SEQID13     TQSEAARSLRAVEKVSFSLEDAQELAGSDDKKSNAVSLVTSSNSCPANTEQVCLTFSSVIESKRFDSLYK
SEQID15     TQSEAARSLRAVEKVSFSLEDAQELAGSDDKKSNAVSLVTSSNSCPANTEQVCLTFSSVIESKRFDSLYK
SEQID2      TQSEAARSLRAVDKVSFSLEDAQELANSENKKTNAISLVTSSDSCPADAEQLCLTFSSVVDRARFEKLYK
SEQID10     TQSEAARSLRAVDKVSFSLEDAQELANSENKKTNAISLVTSSDSCPADAEQLCLTFSSVVDRARFEKLYK
            ************:************ *::**:**:***** :****::**:** ****::  **:.***
PRIM.CONS.  TQSEAARSLRAVEKVSFSLEDAQELAGSDDKKSNAVSLVTSSNSCPANTEQVCLTFSSVIESKRFDSLYK 220        230        240        250        260        270        280
                     |          |          |          |          |          |          |
SEQID3      QIDLAPEEFKKLVNEEVENNAATDKAPSTHTSPVVPVTTPGTKPDLNASFVSANAEQFYQYQPTEIILSE
SEQID4      QIDLAPEEFKKLVNEEVENNAATDKAPSTHTSPVVPVTTPGTKPDLNASFVSANAEQFYQYQPTEIILSE
SEQID12     QIDLAPEEFKKLVNEEVENNAATDKAPSTHTSPVVPVTTPGTKPDLNASFVSANAEQFYQYQPTEIILSE
SEQID16     QIDLAPEEFKKLVNEEVENNAATDKAPSTHTSPVVPVTTPGTKPDLNASFVSANAEQFYQYQPTEIILSE
SEQID5      QIDLAPEEFKKLVNEEVENNAATDKAPSTHTSPVVPVTTPGTKPDLNASFVSANAEQFYQYQPTEIILSE
SEQID14     QIDLAPEEFKKLVNEEVENNAATDKAPSTHTSPVVPVTTPGTKPDLNASFVSANAEQFYQYQPTEIILSE
SEQID6      QIDLAPEEFKKLVNEEVENNAATDKAPSTHTSPVVPVTTPGTKPDLNASFVSANAEQFYQYQPSEIILSE
SEQID8      QIDLAPEEFKKLVNEEVENNAATDKAPSTHTSPVVPVTTPGTKPDLNASFVSANAEQFYQYQPSEIILSE
SEQID9      QIDLAPEEFKKLVNEEVENNAATDKAPSTHTSPVVPATTPGTKPDLNASFVSANAEQFYQYQPTEIILSE
SEQID11     QIDLAPEEFKKLVNEEVENNAATDKAPSTHTSPVVPVTTPGTKPDLNASFVSANAEQFYQYQPTEIILSE
SEQID7      QIDLAPEEFKKLVNEEVENNAATDKAPSTHTSPVVPVTTPGTKPDLNASFVSANAEQFYQYQPSEIILSE
SEQID13     QIDLAPEEFKKLVNEEVENNAATDKAPSTHTSPVVPVTTPGTKPDLNASFVSANAEQFYQYQPTEIILSE
SEQID15     QIDLAPEEFKKLVNEEVENNAATDKAPSTHTSPVVPVTTPGTKPDLNASFVSANAEQFYQYQPTEIILSE
SEQID2      QIDLATDNFSKLVNEEVENNAATDKAPSTHTSTVVPVTTEGTKPDLNASFVSANAEQFYQYQPTEIILSE
SEQID10     QIDLATDNFSKLVNEEVENNAATDKAPSTHTSTVVPVTTEGTKPDLNASFVSANAEQFYQYQPTEIILSE
            *****.::*.********************.***.** ************************:******
PRIM.CONS.  QIDLAPEEFKKLVNEEVENNAATDKAPSTHTSPVVPVTTPGTKPDLNASFVSANAEQFYQYQPTEIILSE
```

FIGURE 1C

```
                    290        300        310        320        330        340        350
                     |          |          |          |          |          |          |
SEQID3      GRLVDSMGNGVVGVNYYTSSGRGVTGENGKFNFSWGETISFGIDTFELGSVRGNKSTIALTELGDEVRGA
SEQID4      GRLVDSMGNGVVGVNYYTSSGRGVTGENGKFNFSWGETISFGIDTFELGSVRGNKSTIALTELGDEVRGA
SEQID12     GRLVDSMGNGVVGVNYYTSSGRGVTGENGKFNFSWGETISFGIDTFELGSVRGNKSTIALTELGDEVRGA
SEQID16     GRLVDSQGYGVAGVNYYTNSGRGVTGENGEFSFSWGETISFGIDTFELGSVRGNKSTIALTELGDEVRGA
SEQID5      GRLVDSQGYGVAGVNYYTNSGRGVTGENGEFSFSWGETISFGIDTFELGSVRGNKSTIALTELGDEVRGA
SEQID14     GRLVDSQGYGVAGVNYYTNSGRGVTGENGEFSFSWGETISFGIDTFELGSVRGNKSTIALTELGDEVRGA
SEQID6      GRLVDSQGYGVAGVNYYTNSGRGVTGENGEFSFSWGETISFGIDTFELGSVRGNKSTIALTELGDEVRGA
SEQID8      GRLVDSQGYGVAGVNYYTNSGRGVTGENGEFSFSWGETISFGIDTFELGSVRGNKSTIALTELGDEVRGA
SEQID9      GRLVDSQGDGVVGVNYYTNSGRGVTGENGEFSFSWGETISFGIDTFELGSVRGNKSTIALTELGDEVRGA
SEQID11     GRLVDSQGYGVAGVNYYTNSGRGVTGENGEFSFSWGEAISFGIDTFELGSVRGNKSTIALTELGDEVRGA
SEQID7      GRLVDSQGYGVAGVNYYTNSGRGVTGENGEFSFSWGETISFGIDTFELGSVRGNKSTIALTELGDEVRGA
SEQID13     GRLVDSQGYGVAGVNYYTNSGRGVTGENGEFSFSWGETISFGIDTFELGSVRGNKSTIALTELGDEVRGA
SEQID15     GRLVDSQGYGVAGVNYYTNSGRGVTGENGEFSFSWGETISFGIDTFELGSVRGNKSTIALTELGDEVRGA
SEQID2      GQLVDSLGNGVAGVDYYTNSGRGVTDENGKFSFSWGETISFGIDTFELGSVRGNKSTIALTELGDEVRGA
SEQID10     GQLVDSLGNGVAGVDYYTNSGRGVTDENGKFSFSWGETISFGIDTFELGSVRGNKSTIALTELGDEVRGA
            *:**** * **.**:*** ****** ***:* *****:*************************:****

PRIM.CONS.  GRLVDSQGYGVAGVNYYTNSGRGVTGENGEFSFSWGETISFGIDTFELGSVRGNKSTIALTELGDEVRGA 360        370        380        390        400        410        420
                     |          |          |          |          |          |          |
SEQID3      NIDQLIHRYSQAGKNDEREVPDVVRKVFAEYPNVINEIINLSLSNGEALSEGDQTFERTNEFLEQFESGQ
SEQID4      NIDQLIHRYSQAGKNDEREVPDVVRKVFAEYPNVINEIINLSLSNGEALSEGDQTFERTNEFLEQFESGQ
SEQID12     NIDQLIHRYSQAGKNDEREVPDVVRKVFAAYPNVINEIINLSLSNGEALSEGDQTFERTNEFLEQFESGQ
SEQID16     NIDQLIHRYSTTGQNNTRVVPDDVRKVFAEYPNVINEIINLSLSNGATLDEGDQNVVLPNEFIEQFKTGQ
SEQID5      NIDQLIHRYSTTGQNNTRVVPDDVRKVFAEYPNVINEIINLSLSNGATLGEGEQVVNLPNEFIEQFNTGQ
SEQID14     NIDQLIHRYSTTGQNNTRVVPDDVRKVFAEYPNVINEIINLSLSNGATLGEGEQVVNLPNEFIEQFNTGQ
SEQID6      NIDQLIHRYSTTGQNNTRVVPDDVRKVFAEYPNVINEIINLSLSNGATLDEGEQVVNLPNEFIEQFKTGQ
SEQID8      NIDQLIHRYSTTGQNNTRVVPDDVRKVFAEYPNVINEIINLSLSNGATLDEGEQVVNLPNEFIEQFKTGQ
SEQID9      NIDQLIHRYSKAGQNHTRVVPDEVRKVFAEYPNVINEIINLSLSNGATLGEGEQVVNLPNEFIEQFKTGQ
SEQID11     NIDQLIHRYSTTGQNNTRVVPDDVRKVFAEYPNVINEIINLSLSNGATLGEGEQVVNLPNEFIEQFNTGQ
SEQID7      NIDQLIHRYSTTGQNNTRVVPDDVRKVFAEYPNVINEIINLSLSNGATLGEGEQVVNLPNEFIEQFKTGQ
SEQID13     NIDQLIHRYSTTGQNNTRVVPDDVRKVFAEYPNVINEIINLSLSNGATLGEGEQVVNLPNEFIEQFNTGQ
SEQID15     NIDQLIHRYSTTGQNNTRVVPEDVRKVFAEYPNVINEIINLSLSNGATLGEGEQVVNLPNEFIEQFNTGQ
SEQID2      NIDQLIHRYSTTGQNNTRVVPDDVRKVFAEYPNVINEIINLSLSNGATLDEGDQNVVLPNEFIEQFKTGQ
SEQID10     NIDQLIHRYSTTGQNNTRVVPDDVRKVFAEYPNVINEIINLSLSNGATLDEGDQNVVLPNEFIEQFKTGQ
            ********** :*:*. * **: ***** ***************** :*.**:* .  .***:***::**

PRIM.CONS.  NIDQLIHRYSTTGQNNTRVVPDDVRKVFAEYPNVINEIINLSLSNGATLGEGEQVVNLPNEFIEQFKTGQ
```

FIGURE 1D

```
                430        440        450        460        470        480        490
                 |          |          |          |          |          |          |
SEQID3      AKEIDTAICDSLGGCNSQRWFSLTARNVNEGQIQGVINKLWGVDKDYKSVTKFHVFHDSTNFYGSTGNAR
SEQID4      AKEIDTAICDSLGGCNSQRWFSLTARNVNDGQIQGVINKLWGVDTNYKSVSKFHVFHDSTNFYGSTGNAR
SEQID12     AKEIDTAICDSLGGCNSQRWFSLTARNVNEGQIQGVINKLWGVDKDYKSVTKFHVFHDSTNFYGSTGNAR
SEQID16     AKEIDTAICAKTDGCNEARWFSLTTRNVNDGQIQGVINKLWGVDKDYKSVTKFHVFHDSTNFYGSTGNAR
SEQID5      AKEIDTAICAKTDGCNEARWFSLTTRNVNDGQIQGVINKLWGVDTNYKSVSKFHVFHDSTNFYGSTGNAR
SEQID14     AKEIDTAICAKTDGCNEARWFSLTTRNVNDGQIQGVINKLWGVDTNYKSVSKFHVFHDSTNFYGSTGNAR
SEQID6      AKEIDTAICAKTDGCNEARWFSLTTRNVNDGQIQGVINKLWGVDTNYKSVSKFHVFHDSTNFYGSTGNAR
SEQID8      AKEIDTAICAKTDGCNEARWFSLTTRNVNDGQIQGVINKLWGVDTNYKSVSKFHVFHDSTNFYGSTGNAR
SEQID9      AKEIDTAICAKTDGCNEARWFSLTTRNVNDGKIQGVINKLWGVDTNYKSVSKFHVFHDSTNFYGSTGNAR
SEQID11     AKEIDTAICAKTDGCNEARWFSLTTRNVNDGQIQGVINKLWGVDTNYKSVSKFHVFHDSTNFYGSTGNAR
SEQID7      AKEIDTAICAKTDGCNEARWFSLTTRNVNDGQIQGVINKLWGVDTNYKSVSKFHVFHDSTNFYGSTGNAR
SEQID13     AKEIDTAICAKTDGCNEARWFSLTTRNVNDGQIQGVINKLWGVDTNYKSVSKFHVFHDSTNFYGSTGNAR
SEQID15     AKEIDTAICAKTDGCNEARWFSLTTRNVNDGQIQGVINKLWGVDTNYKSVSKFHVFHDSTNFYGSTGNAR
SEQID2      AKEIDTAICAKTDGCNEARWFSLTTRNVNDGQIQGVINKLWGVDTNYQSVSKFHVFHDSTNFYGSTGNAR
SEQID10     AKEIDTAICAKTNGCNEARWFSLTTRNVNDGQIQGVINKLWGVDTNYQSVSKFHVFHDSTNFYGSTGNAR
            ********. .***. ******:****:*:************ .:*:**:*******************
PRIM.CONS.  AKEIDTAICAKTDGCNEARWFSLTTRNVNDGQIQGVINKLWGVDTNYKSVSKFHVFHDSTNFYGSTGNAR 500        510        520        530        540        550        560
                 |          |          |          |          |          |          |
SEQID3      GQAVVNISNAAFPILMARNDKNYWLAFGEKRAWDKNELAYITEAPSLVEPENVTRDTATFNLPFISLGQV
SEQID4      GQAVVNISNAAFPILMARNDKNYWLAFGEKRAWDKNELAYITEAPSLVEPENVTRDTATFNLPFISLGQV
SEQID12     GQAVVNISNAAFPILMARNDKNYWLAFGEKRAWDKNELAYITEAPSLVEPENVTRDTATFNLPFISLGQV
SEQID16     GQAVVNISNAAFPILMARNDKNYWLAFGEKRAWDKNELAYITEAPSIVQPENVTRDTATFNLPFISLGQV
SEQID5      GQAVVNISNAAFPILMARNDKNYWLAFGEKRAWDKNELAYITEAPSLVEPENVTRDTATFNLPFISLGQV
SEQID14     GQAVVNISNAAFPILMARNDKNYWLAFGEKRAWDKNELAYITEAPSLVEPENVTRDTATFNLPFISLGQV
SEQID6      GQAVVNISNAAFPILMARNDKNYWLAFGEKRAWDKNELAYITEAPSLVEPENVTRDTATFNLPFISLGQV
SEQID8      GQAVVNISNAAFPILMARNDKNYWLAFGEKRAWDKNELAYITEAPSLVEPENVTRDTATFNLPFISLGQV
SEQID9      GQAVVNISNAAFPILMARNDKNYWLAFGEKRAWDKNELAYITEAPSIVRPENVTRETATFNLPFISLGQV
SEQID11     GQAVVNISNAAFPILMARNDKNYWLAFGEKRAWDKNELAYITEAPSIVRPENVTRETASFNLPFISLGQV
SEQID7      GQAVVNISNAAFPILMARNDKNYWLAFGEKRAWDKNDLAYITEAPSIVRPENVTRETATFNLPFISLGQV
SEQID13     GQAVVNISNAAFPILMARNDKNYWLAFGEKRAWDKNELAYITEAPSIVRPENVTRETATFNLPFISLGQV
SEQID15     GQAVVNISNAAFPILMARNDKNYWLAFGEKRAWDKNELAYITEAPSIVRPENVTRETATFNLPFISLGQV
SEQID2      GQAVVNISNSAFPILMARNDKNYWLAFGEKRAWDKNELAYITEAPSIVQPENVTRDTATFNLPFISLGQV
SEQID10     GQAVVNISNAAFPILMARNDKNYWLAFGEKRAWDKNELAYITEAPSIVQPENVTRDTATFNLPFISLGQV
            ********:********************** *********.* ******:**:**********
PRIM.CONS.  GQAVVNISNAAFPILMARNDKNYWLAFGEKRAWDKNELAYITEAPSIVEPENVTRDTATFNLPFISLGQV
```

FIGURE 1E

```
                    570        580        590        600        610        620        630
                     |          |          |          |          |          |          |
SEQID3      GEGKLMVIGNPHYNSILRCPNGYSWEGGVDKNGQCTRNSDSNDMKHFMQNVLRYLSDDKWTPDAKASMTV
SEQID4      GEGKLMVIGNPHYNSILRCPNGYSWEGGVDKNGQCTRNSDSNDMKHFMQNVLRYLSDDKWTPDAKASMTV
SEQID12     GEGKLMVIGNPHYNSILRCPNGYSWEGGVDKNGQCTRNSDSNDMKHFMQNVLRYLSNDKWTPDAKASMTV
SEQID16     GEGKLMVIGNPHYNSILRCPNGYSWNGGVNKDGQCTLSGDSDDMKHFMQNVLRYLSDDKWTPDAKASMTV
SEQID5      GEGKLMVIGNPHYNSILRCPNGYSWNGGVNKDGQCTLNSDPDDMKNFMENVLRYLSDDKWKPDAKASMTV
SEQID14     GEGKLMVIGNPHYNSILRCPNGYSWNGGVNKDGQCTLNSDPDDMKNFMENVLRYLSDDKWKPDAKASMTV
SEQID6      GEGKLMVIGNPHYNSILRCPNGYSWNGGVNKDGQCTLNSDPDDMKNFMENVLRYLSDDKWTPDAKASMTV
SEQID8      GEGKLMVIGNPHYNSILRCPNGYSWNGGVNKDGQCTLNSDPDDMKNFMENVLRYLSDDKWTPDAKASMTV
SEQID9      GDGKLMVIGNPHYNSILRCPNGYSWNGGVNKDGQCTLNSDPDDMKNFMENVLRYLSDDKWTPDAKASMTV
SEQID11     GDGKLMVIGNPHYNSILRCPNGYSWNGGVNKDGQCTLNSDPDDMKNFMENVLRYLSNDRWLPDAKSSMTV
SEQID7      GDGKLMVIGNPHYNSILRCPNGYSWNGGVNKDGQCTLNSDPDDMKNFMENVLRYLSNDRWLPDAKSSMTV
SEQID13     GDGKLMVIGNPHYNSILRCPNGYSWNGGVNKDGQCTLNSDPDDMKNFMENVLRYLSNDRWLPDAKSNMTV
SEQID15     GDGKLMVIGNPHYNSILRCPNGYSWNGGVNKDGQCTLNSDPDDMKNFMENVLRYLSNDRWLPDAKSNMTV
SEQID2      GEGKLMVIGNPHYNSILRCPNGYSWGGGVNSKGECTLSGDSDDMKHFMQNVLRYLSNDIWQPNTKSIMTV
SEQID10     GDGKLMVIGNPHYNSILRCPNGYSWGGGVNSKGECTLSGDSDDMKHFMQNVLRYLSNDIWQPNTKSIMTV
            *:********************* ***:..*:** ..*.:***:**:******:* * *::*: ***
PRIM.CONS.  GEGKLMVIGNPHYNSILRCPNGYSWNGGVNKDGQCTLNSDPDDMKNFMENVLRYLSDDKWTPDAKASMTV 640        650        660        670        680        690        700
                     |          |          |          |          |          |          |
SEQID3      GTNLDTVYFKRHGQVTGNSAEFGFHPDFAGISVEHLSSYGDLDPQEMPLLILNGFEYVTQVGNDPYAIPL
SEQID4      GTNLDTVYFKRHGQVTGNSAEFGFHPDFAGISVEHLSSYGDLDPQEMPLLILNGFEYVTQVGNDPYAIPL
SEQID12     GTNLDTVYFKRHGQVTGNSAEFGFHPDFAGISVEHLSSYGDLDPQKMPLLILNGFEYVTQVGGDPYAVPL
SEQID16     GTNLDTVYFKRHGQVTGNSAEFGFHPDFAGISVEHLSSYGDLDPQEMPLLILNGFEYVTQVGNDPYAIPL
SEQID5      GTNLDTVYFKRHGQVTGNSAAFDFHPDFAGISVEHLSSYGDLDPQEMPLLILNGFEYVTQVGNDPYAIPL
SEQID14     GTNLDTVYFKRHGQVTGNSAAFDFHPDFAGISVEHLSSYGDLDPQEMPLLILNGFEYVTQVGNDPYAIPL
SEQID6      GTNLDTVYFKRHGQVTGNSAAFDFHPDFAGISVEHLSSYGDLDPQEMPLLILNGFEYVTQVGNDPYAIPL
SEQID8      GTNLDTVYFKRHGQVTGNSAAFDFHPDFAGISVEHLSSYGDLDPQEMPLLILNGFEYVTQVGNDPYAIPL
SEQID9      GTNLDTVYFKRHGQVTGNSAAFDFHPDFAGISVEHLSSYGDLDPQEMPLLILNGFEYVTQVGNDPYAIPL
SEQID11     GTNLETVYFKKHGQVLGNSAPFAFHKDFTGITVKPMTSYGNLNPDEVPLLILNGFEYVTQWGSDPYSIPL
SEQID7      GTNLDTVYFKKHGQVLGNSAPFAFHKDFTGITVKPMTSYGNLNPDEVPLLILNGFEYVTQWGSDPYSIPL
SEQID13     GTNLDTVYFKRHGQVTGNSAAFGFHPDFAGISVEHLSSYGDLDPQEMPLLILNGFEYVTQVGNDPYAIPL
SEQID15     GTNLDTVYFKKHGQVTGNSAAFGFHPDFAGISVEHLSSYGDLDPQEMPLLILNGFEYVTQVGNDPYAIPL
SEQID2      GTNLENVYFKKAGQVLGNSAPFAFHEDFTGITVKQLTSYGDLNPEEIPLLILNGFEYVTQWSGDPYAVPL
SEQID10     GTNLENVYFKKAGQVLGNSAPFAFHEDFTGITVKQLTSYGDLNPEEIPLLILNGFEYVTQWSGDPYAVPL
            ****:.****: *** **** * ** **:**:*: ::***:*:*:::************* ..***::**
PRIM.CONS.  GTNLDTVYFKRHGQVTGNSAAFGFHPDFAGISVEHLSSYGDLDPQEMPLLILNGFEYVTQVGNDPYAIPL
```

FIGURE 1F

```
                    710        720        730        740        750        760        770
                     |          |          |          |          |          |          |
SEQID3      RADTSKPKLTQQDVTDLIAYLNKGGSVLIMENVMSNLKEESASGFVRLLDAAGLSMALNKSVVNNDPQGY
SEQID4      RADTSKPKLTQQDVTDLIAYLNKGGSVLIMENVMSNLKEESASGFVRLLDAAGLSMALNKSVVNNDPQGY
SEQID12     RADTSKPKLSQQDVTDLIAYLNKGGSVLIMENVMSNLKEESASGFVRLLDAAGLSMALNKSVVNNDPQGY
SEQID16     RADTSKPKLTQQDVTDLIAYLNKGGSVLIMENVMSNLKEESASGFVRLLDAAGLSMALNKSVVNTDPQGY
SEQID5      RADTSKPKLTQQDVTDLIAYLNKGGSVLIMENVMSNLKEESASGFVRLLDAAGLSMALNKSVVNNDPQGY
SEQID14     RADTSKPKLTQQDVTDLIAYLNKGGSVLIMENVMSNLKEESASGFVRLLDAAGLSMALNKSVVNNDPQGY
SEQID6      RADTSKPKLTQQDVTDLIAYLNKGGSVLIMENVMSNLKEESASGFVRLLDAAGLSMALNKSVVNNDPQGY
SEQID8      RADTSKPKLTQQDVTDLIAYLNKGGSVLIMENVMSNLKEESASGFVRLLDAAGLSMALNKSVVNNDPQGY
SEQID9      RADTSKPKLTQQDVTDLIAYLNKGGSVLIMENVMSNLKEESASGFVRLLDAAGLSMALNKSVVNNDPQGY
SEQID11     RADTSKPKLTQQDVTDLIAYMNKGGSVLIMENVMSNLKEESASGFVRLLDAAGLSMALNKSVVNNDPQGY
SEQID7      RADTSKPKLTQQDVTDLIAYMNKGGSVLIMENVMSNLKEESASGFVRLLDAAGLSMALNKSVVNNDPQGY
SEQID13     RADTSKPKLTQQDVTDLIAYMNKGGSVLIMENVMSNLKEESASGFVRLLDAAGLSMALNKSVVNNDPQGY
SEQID15     RADTSKPKLTQQDVTDLIAYMNKGGSVLIMENVMSNLKEESASGFVRLLDAAGLSMALNKSVVNNDPQGY
SEQID2      RADTSKPKLTQQDVTDLIAYLNKGGSVLIMENVMSNLKEESASSFVRLLDAAGLSMALNKSVVNNDPQGY
SEQID10     RADTSKPKLTQQDVTDLIAYLNKGGSVLIMENVMSNLKEESASSFVRLLDAAGLSMALNKSVVNNDPQGY
            ********:**********:*********************.********************.*****
PRIM.CONS.  RADTSKPKLTQQDVTDLIAYLNKGGSVLIMENVMSNLKEESASGFVRLLDAAGLSMALNKSVVNNDPQGY 780        790        800        810        820        830        840
                     |          |          |          |          |          |          |
SEQID3      PNRVRQQRATGIWVYERYPAVDGALP-YTIDSKTGEVKWKYQVENKPDDKPKLEVASWLEDVDGKQETRY
SEQID4      PNRVRQQRATGIWVYERYPAVDGALP-YTIDSKTGEVKWKYQVENKPDDKPKLEVASWLEDVDGKQETRY
SEQID12     PDRVRQRRATGIWVYERYPVVEGELP-YTIDSKTGKVTWKYQIDNKPDKKPKLEVASWQEEVDGKQVTQF
SEQID16     PNRVRQQREKGIWVYERYPAVDSAQPPYTIDPDTGKVTWKYQEEGKPDDKPKLEVASWQEDVDGKQVTRY
SEQID5      PNRVRQQRATGIWVYERYPAVDGALP-YTIDSKTGEVKWKYQVENKPDDKPKLEVASWLEDVDGKQETRY
SEQID14     PNRVRQQRATGIWVYERYPAVDGALP-YTIDSKTGEVKWKYQVENKPDDKPKLEVASWLEDVDGKQETRY
SEQID6      PNRVRQQRATGIWVYERYPAVDGALP-YTIDSKTGEVKWKYQVENKPDDKPKLEVASWLEDVDGKQETRY
SEQID8      PNRVRQQRATGIWVYERYPAVDGALP-YTIDSKTGEVKWKYQVENKPDDKPKLEVASWLEDVDGKQETRY
SEQID9      PNRVRQRRSTPIWVYERYPAVDGKPP-YTIDDTTKEVIWKYQQENKPDDKPKLEVASWQEEVEGKQVTQF
SEQID11     PDRVRQRRSTPIWVYERYPAVDGKPP-YTIDDTTKEVIWKYQQENKPDDKPKLEVASWQEEVEGKQVTQF
SEQID7      PDRVRQRRSTPIWVYERYPAVDGKPP-YTIDDTTKEVIWKYQQENKPDDKPKLEVASWQEEVEGKQVTQF
SEQID13     PDRVRQRRSTPIWVYERYPAVDGKPP-YTIDDTTKEVIWKYQQENKPDDKPKLEVASWQEEVEGKQVTQF
SEQID15     PDRVRQRRSTPIWVYERYPAVDGKPP-YTIDDTTKEVIWKYQQENKPDDKPKLEVASWQEEVEGKQVTQF
SEQID2      PDRVRQRRATGIWVYERYPAADGAQPPYTIDPNTGEVTWKYQQDNKPDDKPKLEVASWQEEVEGKQVTRY
SEQID10     PDRVRQQREKGIWVYERYPFVDG-KPPYTIDETTKEVIWKYQQDNKPDDKPKLEVASWLEDVDGKQVKRY
            *:****:* . ********  .:.  * ****  * :* **** :.***.********* *:*:***  .::
PRIM.CONS.  PNRVRQQRATGIWVYERYPAVDGALPPYTIDSKTGEV2WKYQQENKPDDKPKLEVASWQEDVDGKQVTRY
```

FIGURE 1G

```
               850        860        870        880        890        900        910
                |          |          |          |          |          |          |
SEQID3     AFIDEADHKTEDSLKAAKAKIFEKFPGLKECKDPTYHYEVNCLEYRPGTGVPVTGGMYVPQYTQLSLNAD
SEQID4     AFIDEADHKTEDSLKAAKAKIFEKFPGLKECKDPTYHYEVNCLEYRPGTGVPVTGGMYVPQYTQLSLNAD
SEQID12    AFIDEADHKTTESLDAAKKKILEKFKGLEECKDSTYHYEINCLEYRPGTNVPATGGMYVPRYTQLNLSAD
SEQID16    AFIDEAEHSTEESLEAAKAKIFEKFPGLQECKDSTYHYEINCLERRPGTDVPVTGGMYVPRYTQLNLDAD
SEQID5     AFIDEADHKTEDSLKAAKEKIFAAFPGLKECTNPAYHYEVNCLEYRPGTGVPVTGGMYVPQYTQLSLNAD
SEQID14    AFIDEADHKTEDSLKAAKEKIFAAFPGLKECTNPAYHYEVNCLEYRPGTGVPVTGGMYVPQYTQLSLNAD
SEQID6     AFIDEADHKTEDSLKAAKEKIFAAFPGLKECTNPAYHYEVNCLEYRPGTGVPVTGGMYVPQYTQLSLNAD
SEQID8     AFIDEADHKTEDSLKAAKEKIFAAFPGLKECTNPAYHYEVNCLEYRPGTGVPVTGGMYVPQYTQLSLNAD
SEQID9     AFIDEADHKTPESLAAAKQRILDAFPGLEVCKDSDYHYEVNCLEYRPGTDVPVTGGMYVPQYTQLDLSAD
SEQID11    AFIDEADHKTPESLAAAKQRILDAFPGLEVCKDSDYHYEVNCLEYRPGTDVPVTGGMYVPQYTQLDLSAD
SEQID7     AFIDEADHKTPESLAAAKQRILDAFPGLEVCKDSDYHYEVNCLEYRPGSGVPVTGGMYVPQYTQLDLGAD
SEQID13    AFIDEADHKTPESLAAAKKRILDAFPGLEECKDSDYHYEVNCLEYRPGTGVPVTGGMYVPQYTQLSLNAD
SEQID15    AFIDEADHKTPESLAAAKKRILDAFPGLEECKDSDYHYEVNCLEYRPGTGVPVTGGMYVPQYTQLSLNAD
SEQID2     AFIDEAEYTTEESLEAAKAKIFEKFPGLQECKDSTYHYEINCLERRPGTDVPVTGGMYVPRYTQLNLDAD
SEQID10    AFIDEAEHETNESLEAAKAKIIKAFPGLEECKDPTYHYEVNCLEYRPGTNVPVTGGMYVPRYTQLNLSAD
           ******:: * :** *** :*:    * **: *.:. ****:**** ***:.**.*******:****.*.**
PRIM.CONS. AFIDEADHKTEESLKAAKAKIF2AFPGLEECKDSTYHYEVNCLEYRPGTGVPVTGGMYVPQYTQLSLNAD 920        930        940        950        960        970        980
                |          |          |          |          |          |          |
SEQID3     TAKAMVQAADLGTNIQRLYQHELYFRTNGRKGERLSSVDLERLYQNMSVWLWNKIEYRYENDKDDELGFK
SEQID4     TAKAMVQAADLGTNIQRLYQHELYFRTNGRKGERLSSVDLERLYQNMSVWLWNKIEYRYENDKDDELGFK
SEQID12    TAKAMVQAADLGTNIQRLYQHELYFRTNGRKGERLSSVDLERLYQNMSVWLWNEIEYSYDSSKEDELGFK
SEQID16    TAKAMVQAADLGTNIQRLYQHELYFRTNGRKGERLSSVDLERLYQNMSVWLWNKIEYRYENDKDDELGFK
SEQID5     TAKAMVQAADLGTNIQRLYQHELYFRTNGRKGERLSSVDLERLYQNMSVWLWNDTSYRYEEGKNDELGFK
SEQID14    TAKAMVQAADLGTNIQRLYQHELYFRTNGRKGERLSSVDLERLYQNMSVWLWNDTSYRYEEGKNDELGFK
SEQID6     TAKAMVQAADLGTNIQRLYQHELYFRTNGRKGERLCVDLERLYQNMSVWLWNDTSYRYEEGKNDELGFK
SEQID8     TAKAMVQAADLGTNIQRLYQHELYFRTNGRKGERLSSVDLERLYQNMSVWLWNDTSYRYEEGKNDELGFK
SEQID9     TAKAMLQAADLGTNIQRLYQHELYFRTNGRQGERLNSVDLERLYQNMSVWLWNETKYRYEEGKEDELGFK
SEQID11    TAKAMLQAADLGTNIQRLYQHELYFRTNGRQGERLNSVDLERLYQNMSVWLWNETKYRYEEGKEDELGFK
SEQID7     TAKAMLQAADLGTNIQRLYQHELYFRTNGRQGERLNSVDLERLYQNMSVWLWNETKYRYEEGKEDELGFK
SEQID13    TAKAMVQAADLGTNIQRLYQHELYFRTNGRKGERLSSVDLERLYQNMSVWLWNKIEYRYENDKDDELGFK
SEQID15    TAKAMVQAADLGTNIQRLYQHELYFRTNGRKGERLSSVDLERLYQNMSVWLWNKIEYRYENDKDDELGFK
SEQID2     TAKAMVQAADLGTNIQRLYQHELYFRTKGSKGERLNSVDLERLYQNMSVWLWNDTKYRYEEGKEDELGFK
SEQID10    TAKAMVQAADLGTNIQRLYQHELYFRTNGRKGERLSSVDLERLYQNMSVWLWNEIEYSYDSSKEDELGFK
           ****:******************:* :****..***************. * *:..*:******
PRIM.CONS. TAKAMVQAADLGTNIQRLYQHELYFRTNGRKGERLSSVDLERLYQNMSVWLWN3TEYRYEEGKEDELGFK
```

FIGURE 1H

```
                   990       1000      1010      1020      1030      1040      1050
                    |         |         |         |         |         |         |
SEQID3      TFTEFLNCYANDAYTGGTQCSDELKKSLVDNNMIYGEKSVNKAGMMNPSYPLNYMEKPLTRLMLGRSWWD
SEQID4      TFTEFLNCYANDAYTGGTQCSDELKKSLVDNNMIYGEKSVNKAGMMNPSYPLNYMEKPLTRLMLGRSWWD
SEQID12     TFTEFLNCYANDAYTGGTQCSDELKKSLVDNNMIYGEKSVNKAGMMNPSYPLNYMEKPLTRLMLGRSWWD
SEQID16     TFTEFLNCYANNAYSEGTQCSADLKKSLVDNNMIYGDSS-KAGMMNPSYPLNYMEKPLTRLMLGRSWWD
SEQID5      TFTEFLNCYANDAYAGGTKCSADLKKSLVDNNMIYGDSS-KAGMMNPSYPLNYMEKPLTRLMLGRSWWD
SEQID14     TFTEFLNCYANDAYAGGTKCSADLKKSLVDNNMIYGDSS-KAGMMNPSYPLNYMEKPLTRLMLGRSWWD
SEQID6      TFTEFLNCYANDAYAGGTKCSADLKKSLVDNNMIYGDSS-KAGMMNPSYPLNYMEKPLTRLMLGRSWWD
SEQID8      TFTEFLNCYANDAYAGGTKCSADLKKSLVDNNMIYGDSS-KAGMMNPSYPLNYMEKPLTRLMLGRSWWD
SEQID9      TFTEFLNCYTNNAYVG-TQCSAELKKSLIDNKMIYGEESS-KAGMMNPSYPLNYMEKPLTRLMLGRSWWD
SEQID11     TFTEFLNCYTNNAYVG-TQCSAELKKSLIDNKMIYGEESS-KAGMMNPSYPLNYMEKPLTRLMLGRSWWD
SEQID7      TFTEFLNCYTNNAYVG-TQCSAELKKSLIDNKMIYGEESS-KAGMMNPSYPLNYMEKPLTRLMLGRSWWD
SEQID13     TFTEFLNCYANNAYDGGTQCSAELKQSLIDNKMIYGE-GS-KAGMMNPSYPLNYMEKPLTRLMLGRSWWD
SEQID15     TFTEFLNCYANNAYDGGTQCSAELKQSLIDNKMIYGE-GS-KAGMMNPSYPLNYMEKPLTRLMLGRSWWD
SEQID2      TFTEFLNCYANDAYAGGTKCSADLKKSLVDNNMIYGDSS-KAGMMNPSYPLNYMEKPLTRLMLGRSWWD
SEQID10     TFTEFLNCYANDAYTKGTLCSAELKQSLIDNKMIYGEGS--KAGMMNPSYPLNYMEKPLTRLMLGRSWWD
            ********:*:**  * **.:**:**:**:****:    ****************************
PRIM.CONS.  TFTEFLNCYANDAYAGGTQCSAELKKSLVDNNMIYGEGSSNKAGMMNPSYPLNYMEKPLTRLMLGRSWWD 1060      1070      1080      1090      1100      1110      1120
                    |         |         |         |         |         |         |
SEQID3      LNIKVDVEKYPGAVSAEGEKVTETISLYSNPTKWFAGNMQSTGLWAPAQKEVTIESSASVPVTVTVALAD
SEQID4      LNIKVDVEKYPGAVSAEGEKVTETISLYSNPTKWFAGNMQSTGLWAPAQKEVTIESTASVAVTVTVALAD
SEQID12     LNIKVDVEKYPGAVSEEGQEVTESISLYSNPTKWFAGNMQSTGLWAPAQKEVTIKSNADVPVTVTVALAD
SEQID16     LNIKVDVEKYPGAVSAEGEKVTETISLYSNPTKWFAGNMQSTGLWAPAQQEVTIESTASVPVTVTVALAD
SEQID5      LNIKVDVEKYPGAVSEEGQNVTETISLYSNPTKWFAGNMQSTGLWAPAQKEVTIKSNANVPVTVTVALAD
SEQID14     LNIKVDVEKYPGAVSEEGQNVTETISLYSNPTKWFAGNMQSTGLWAPAQKEVTIKSNANVPVTVTVALAD
SEQID6      LNIKVDVEKYPGAVSEEGQNVTETISLYSNPTKWFAGNMQSTGLWAPAQKEVTIKSNANVPVTVTVALAD
SEQID8      LNIKVDVEKYPGAVSEEGQNVTETISLYSNPTKWFAGNMQSTGLWAPAQKEVTIKSNANVPVTVTVALAD
SEQID9      LNIKVDVEKYPGVVNTNGETVTQNINLYSAPTKWFAGNMQSTGLWAPAQQEVSIESKATVPVTVTVALAD
SEQID11     LNIKVDVEKYPGVVNTNGETVTQNINLYSAPTKWFAGNMQSTGLWAPAQQEVSIESKSTVPVTVTVALAD
SEQID7      LNIKVDVEKYPGAVSEEGQNVTETISLYSNPTKWFAGNMQSTGLWAPAQKEVTIKSNANVPVTVTVALAD
SEQID13     LNIKVDVEKYPGAVSAEGEEVTETINLYSNPTKWFAGNMQSTGLWAPAQQEVSIKSNAKVPVTVTVALAD
SEQID15     LNIKVDVEKYPGAVSAEGEEVTETINLYSNPTKWFAGNMQSTGLWAPAQQEVSIKSNAKVPVTVTVALAD
SEQID2      LNIKVDVEKYPGSVSAKGESVTENISLYSNPTKWFAGNMQSTGLWAPAQQDVTIKSSASVPVTVTVALAD
SEQID10     LNIKVDVEKYPGAVSVGGEEVTETISLYSNPTKWFAGNMQSTGLWAPAQKEVTIKSNANVPVTVTVALAD
            ***********.*:.**:.*.*** *******************::*:*:*.: *.*********
PRIM.CONS.  LNIKVDVEKYPGAVS2EGENVTETISLYSNPTKWFAGNMQSTGLWAPAQKEVTIKSNANVPVTVTVALAD
```

FIGURE 1I

```
                 1130      1140      1150      1160      1170      1180      1190
                   |         |         |         |         |         |         |
SEQID3     DLTGREKHEVALNRPPKVTKTYELKANGEVKFTVPYGGLIYIKGNSPQN-ESAEFTFTGVVKAPFYKDGA
SEQID4     DLTGREKHEVALNRPPKVTKTYELKANGEVKFTVPYGGLIYIKGNSPQN-ESAEFTFTGVVKAPFYKDGA
SEQID12    DLTGREKHEVALNRPPKVTKTYELKANGEVKFTVPYGGLIYIKGNSKENNKSASFTFTGVVKAPFYKNGA
SEQID16    DLTGREKHEVALNRPPKVTKTYDLKANDKVTFKVPYGGLIYIKGNSPKN-ESAEFTFTGVVKAPFYKDGE
SEQID5     DLTGREKHEVALNRPPRVTKTYSLDASGTVKFKVPYGGLIYIKGNSSTN-ESASFTFTGVVKAPFYKDGA
SEQID14    DLTGREKHEVALNRPPRVTKTYSLDASGTVKFKVPYGGLIYIKGNSSTN-ESASFTFTGVVKAPFYKDGA
SEQID6     DLTGREKHEVALNRPPRVTKTYSLDASGTVKFKVPYGGLIYIKGNSSTN-ESASFTFTGVVKAPFYKDGA
SEQID8     DLTGREKHEVALNRPPRVTKTYSLDASGTVKFKVPYGGLIYIKGNSSTN-ESASFTFTGVVKAPFYKDGA
SEQID9     DLTGREKHEVSLNRPPRVTKTYDLKANDKVTFKVPYGGLIYIKGDSKEV-QSADFTFTGVVKAPFYKDGK
SEQID11    DLTGREKHEVSLNRPPRVTKTYDLKANDKVTFKVPYGGLIYIKGDSKEV-QSADFTFTGVVKAPFYKDGK
SEQID7     DLTGREKHEVALNRPPRVTKTYSLDASGTVKFKVPYGGLIYIKGNSSTN-ESASFTFTGVVKAPFYKDGA
SEQID13    DLTGREKHEVALNRPPRVTKTYSLDASGTVKFKVPYGGLIYIKSDSKEE-KSANFTFTGVVKAPFYKDGK
SEQID15    DLTGREKHEVALNRPPRVTKTYSLDASGTVKFKVPYGGLIYIKSDSKEE-KSANFTFTGVVKAPFYKDGK
SEQID2     DLTGREKHEVALNRPPRVTKTYTLEANGEVTFKVPYGGLIYIKGDSKDD-VSANFTFTGVVKAPFYKDGE
SEQID10    DLTGREKHEVALNRPPRVTKTYSLDASGTVKFKVPYGGLIYIKGNSSTN-ESASFTFTGVVKAPFYKDGA
           **********:*****:***** *.*.. *.*.**********.:*    **.**************:*
PRIM.CONS. DLTGREKHEVALNRPPRVTKTYSLDASGTVKFKVPYGGLIYIKGNS2TNNESASFTFTGVVKAPFYKDGA 1200      1210      1220      1230      1240      1250      1260
                   |         |         |         |         |         |         |
SEQID3     WKNALNSPAPLGELESDAFVYTTPKKNLEAS---NFTGGVAEFAKDLDTFASSMNDFYGRNDEDGKHRMF
SEQID4     WKNALNSPAPLGELESDAFVYTTPKKNLEAS---NYKGGQEQFAEELDTFASSMNDFYGRNDEDGKHRMF
SEQID12    WKNALNSPAPLGELESDAFVYTTPKKNLEAS---NFTGGVAEFAKDLDTFASSMNDFYGRNDEDGKHRMF
SEQID16    WKNALNSPAPLGELESDSFVYTAPKNNLNASNYSNYTDGVAEFAKELDTFASSMNDFYGRDGESGNHRMF
SEQID5     WKNDLNSPAPLGELESDAFVYTTPKKNLNAS---NYTGGLEQFANDLDTFASSMNDFHGRDSEDGKHRMF
SEQID14    WKNDLNSPAPLGELESDAFVYTTPKKNLNAS---NYTGGLEQFANDLDTFASSMNDFYGRDSEDGKHRMF
SEQID6     WKNDLNSPAPLGELESDAFVYTTPKKNLNAS---NYTGGLEQFANDLDTFASSMNDFYGRDSEDGKHRMF
SEQID8     WKNDLNSPAPLGELESDAFVYTTPKKNLNAS---NYTGGLEQFANDLDTFASSMNDFYGRDETSGKHRMF
SEQID9     WQHDLNSPAPLGELESASFVYTTPKKNLNAS---NYTGGLEQFANDLDTFASSMNDFYGRDSEDGKHRMF
SEQID11    WQHDLNSPAPLGELESASFVYTTPKKNLNAS---NYTGGLEQFANDLDTFASSMNDFYGRDSEDGKHRMF
SEQID7     WKNDLNSPAPLGELESDAFVYTTPKKNLNAS---NYTGGLEQFANDLDTFASSMNDFYGRDSESGKHRMF
SEQID13    WKNDLKSPAPLGELESASFVYTTPKKNLEAS---NYKGGLKQFAEDLDTFASSMNDFYGRDGESGKHRMF
SEQID15    WKNDLKSPAPLGELESASFVYTTPKKNLEAS---NYKGGLKQFAEDLDTFASSMNDFYGRDGESGKHRMF
SEQID2     WKNDLDSPAPLGELESASFVYTTPKKNLEAS---NFTGGVAEFAKDLDTFASSMNDFYGRNDEDGKHRMF
SEQID10    WKNDLNSPAPLGELESASFVYTTPKKNLNAS---NYTGGLDQFAKDLDTFASSMNDFYGRNDEDGKHRMF
           *::  *.**********  :****:**:**:**   *:..*  :**:::***********:**:   .*:****
PRIM.CONS. WKNDLNSPAPLGELESDAFVYTTPKKNLNASNYSNYTGGLEQFANDLDTFASSMNDFYGRDSEDGKHRMF
```

FIGURE 1J

```
                    1270       1280       1290       1300       1310       1320       1330
                      |          |          |          |          |          |          |
SEQID3       TYKNLTGHKHRFTNDVQISIGDAHSGYPVMNSSFSTNSTTLPTTPLNDWLIWHEVGHNAAETPLTVPGAT
SEQID4       TYKNLTGHKHRFTNDVQISIGDAHSGYPVMNSSFSTNSTTLPTTPLNDWLIWHEAGHNAAETPLTVPGAT
SEQID12      TYKNLTGHKHRFTNDVQISIGDAHSGYPVMNSSFSTNSTTLPTTPLNDWLIWHEVGHNAAETPLTVPGAT
SEQID16      TYKALTGHKHRFANDVQISIGDAHSGYPVMNSSFSTNSTTLPTTPLNDWLIWHEVGHNAAETPLNVPGAT
SEQID5       TYKNLPGHKHRFTNDVQISIGDAHSGYPVMNSSFSPNSTTLPTTPLNDWLIWHEVGHNAAETPLTVPGAT
SEQID14      TYKNLPGHKHRFTNDVQISIGDAHSGYPVMNSSFSPNSTTLPTTPLNDWLIWHEVGHNAAETPLTVPGAT
SEQID6       TYKNLPGHKHRFANDVQISIGDAHSGYPVMNSSFSPNSTTLPTTPLNDWLIWHEVGHNAAETPLTVPGAT
SEQID8       TYKNLTGHKHRFTNDVQISIGDAHSGYPVMNSSFSTNSTTLPTTPLNDWLIWHEVGHNAAETPLTVPGAT
SEQID9       TYKNLPGHKHRFANDVQISIGDAHSGYPVMNSSFSPNSTTLPTTPLNDWLIWHEVGHNAAETPLTVPGAT
SEQID11      TYKNLPGHKHRFANDVQISIGDAHSGYPVMNSSFSPNSTTLPTTPLNDWLIWHEVGHNAAETPLTVPGAT
SEQID7       TYKNLTGHKHRFANDVQISIGDAHSGYPVMNSSFSPNSTTLPTTPLNDWLIWHEVGHNAAETPLTVPGAT
SEQID13      TYEALTGHKHRFTNDVQISIGDAHSGYPVMNSSFSPNSTTLPTTPLNDWLIWHEVGHNAAETPLTVPGAT
SEQID15      TYEALTGHKHRFTNDVQISIGDAHSGYPVMNSSFSPNSTTLPTTPLNDWLIWHEVGHNAAETPLTVPGAT
SEQID2       TYKNLTGHKHRFTNDVQISIGDAHSGYPVMNSSFSTNSTTLPTTPLNDWLIWHEVGHNAAETPLNVPGAT
SEQID10      TYKNLTGHKHRFTNDVQISIGDAHSGYPVMNSSFSTNSTTLPTTPLNDWLIWHEVGHNAAETPLNVPGAT
             **: *.******:*********************.*****************.*********.*****
PRIM.CONS.   TYKNLTGHKHRFTNDVQISIGDAHSGYPVMNSSFSPNSTTLPTTPLNDWLIWHEVGHNAAETPLTVPGAT 1340       1350       1360       1370       1380       1390       1400
                      |          |          |          |          |          |          |
SEQID3       EVANNVLALYMQDRYLGKMNRVADDITVAPEYLEESNGQAWARGGAGDRLLMYAQLKEWAEKNFDIKQWY
SEQID4       EVANNVLALYMQDRYLGKMNRVADDITVAPEYLEESNNQAWARGGAGDRLLMYAQLKEWAEKNFDITKWY
SEQID12      EVANNVLALYMQDRYLGKMNRVADDITVAPEYLEESNNQAWARGGAGDRLLMYAQLKEWAEENFDIKKWY
SEQID16      EVANNVLALYMQDRYLGKMNRVADDITVAPEYLDESNGQAWARGGAGDRLLMYAQLKEWAEENFDIKQWY
SEQID5       EVANNVLALYMQDRYLGKMNRVADDITVAPEYLEESNNQAWARGGAGDRLLMYAQLKEWAEKNFDIKKWY
SEQID14      EVANNVLALYMQDRYLGKMNRVADDITVAPEYLEESNNQAWARGGAGDRLLMYAQLKEWAEKNFDIKKWY
SEQID6       EVANNVLALYMQDRYLGKMNRVADDITVAPEYLEESNGQAWARGGAGDRLLMYAQLKEWAEKNFDIKKWY
SEQID8       EVANNVLALYMQDRYLGKMNRVADDITVAPEYLEESNGQAWARGGAGDRLLMYAQLKEWAEKNFDIKKWY
SEQID9       EVANNVLALYMQDRYLGKMNRVADDITVAPEYLEESNGQAWARGGAGDRLLMYAQLKEWAEKNFDIKKWY
SEQID11      EVANNVLALYMQDRYLGKMNRVADDITVAPEYLEESNGQAWARGGAGDRLLMYAQLKEWAEKNFDIKKWY
SEQID7       EVANNVLALYMQDRYLGKMNRVADDITVAPEYLEESNGQAWARGGAGDRLLMYAQLKEWAEKNFDIKKWY
SEQID13      EVANNVLALYMQDRYLGKMNRVADDITVAPEYLEESNGQAWARGGAGDRLLMYAQLKEWAEKNFDIKQWY
SEQID15      EVANNVLALYMQDRYLGKMNRVADDITVAPEYLEESNGQAWARGGAGDRLLMYAQLKEWAEKNFDIKQWY
SEQID2       EVANNVLALYMQDRYLGKMNRVADDITVAPEYLDESNGQAWARGGAGDRLLMYAQLKEWAEENFDIKQWY
SEQID10      EVANNVLALYMQDRYLGKMNRVADDITVAPEYLDESNGQAWARGGAGDRLLMYAQLKEWAEKNFDITKWY
             *********************************:***.*********************:****.:**
PRIM.CONS.   EVANNVLALYMQDRYLGKMNRVADDITVAPEYLEESNGQAWARGGAGDRLLMYAQLKEWAEKNFDIKKWY
```

FIGURE 1K

```
                   1410       1420       1430       1440       1450       1460       1470
                    |          |          |          |          |          |          |
SEQID3      PEGD-LPKFYSDREGMKGWNLFQLMHRKARGDEVGKTKFGERNYCAESNGNAADKLMLCASWVAQTDLSE
SEQID4      PEGN-LPKFYSEREGMKGWNLFQLMHRKARGDEVGKTKFGERNYCAESNGNAADTLMLCASWVAQTDLSA
SEQID12     PDGTPLPEFYSEREGMKGWNLFQLMHRKARGDEVSNDKFGGRNYCAESNGNTADTLMLCASWVAQTDLSE
SEQID16     PDGE-LPKFYSDRKGMKGWNLFQLMHRKARGDDVSNDKFGGRNYCAESNGNAADTLMLCASWVAQADLSE
SEQID5      PDGTPLPEFYSEREGMKGWNLFQLMHRKARGDEVSNDKFGGKNYCAESNGNAADTLMLCASWVAQTDLSE
SEQID14     PDGTPLPEFYSEREGMKGWNLFQLMHRKARGDEVSNDKFGGKNYCAESNGNAADTLMLCASWVAQTDLSE
SEQID6      PDGTPLPEFYSEREGMKGWNLFQLMHRKARGDEVSNDKFGGKNYCAESNGNAADTLMLCASWVAQTDLSE
SEQID8      PEGE-LPKFFSDREGMKGWNLFQLMHRKARGDDVGDKTFGGKNYCAESNGNAADTLMLCASWVAQTDLSA
SEQID9      PDGTPLPEFYSEREGMKGWNLFQLMHRKARGDEVSNDKFGGKNYCAESNGNAADTLMLCASWVAQTDLSE
SEQID11     PDGTPLPEFYSEREGMKGWNLFQLMHRKARGDEVSNDKFGGKNYCAESNGNAADTLMLCASWVAQTDLSE
SEQID7      PEGE-LPKFFSDREGMKGWNLFQLMHRKARGDDVGNKTFGGKNYCAESNGNAADSLMLCASWVAQTDLSA
SEQID13     PEGS-LPAFYSEREGMKGWNLFQLMHRKARGDDVGNDKFGNRNYCAESNGNAADTLMLCASWVAQTDLSA
SEQID15     PEGS-LPAFYSEREGMKGWNLFQLMHRKARGDDVGNDKFGNRNYCAESNGNAADTLMLCASWVAQTDLSA
SEQID2      PDGE-LPKFYSDRKGMKGWNLFQLMHRKARGDDVGNSTFGGKNYCAESNGNAADTLMLCASWVAQADLSE
SEQID10     PDGK-LPAFYSEREGMKGWNLFQLMHRKARGDDVGNSTFGGKNYCAESNGNAADTLMLCASWVAQTDLSE
            *:*   ** *:*:*:******************:*   .**  :*********:**.**********:***
PRIM.CONS.  PDGTPLP2FYSEREGMKGWNLFQLMHRKARGDEVGNDKFGGKNYCAESNGNAADTLMLCASWVAQTDLSE 1480       1490       1500       1510       1520       1530
                    |          |          |          |          |          |
SEQID3      FFKKWNPGANAYQLPGASEMNFEGGVSQSAYETLAALNLPKPQQGPETINQVTEHKMSAE
SEQID4      FFKKWNPGANAYQLPGASEMNFEGGVSQSAYETLAALNLPKPQQGPETINKVTEYSMPAE
SEQID12     FFKKWNPGANAYQLPGATEMSFEGGVSQSAYNTLASLDLPKPKQGPETINKVTEYSMPAE
SEQID16     FFKKWNPGANAYQLPGASEMSFEGGVSQSAYNTLAAMHLSKPEKGPETINKVTEYSMPAE
SEQID5      FFKKWNPGANAYQLPGASEMSFEGGVSQSAYNTLASLDLPKPEQGPETINQVTEHKMSAE
SEQID14     FFKKWNPGANAYQLPGASEMSFEGGVSQSAYNTLASLDLPKPEQGPETINQVTEHKMSAE
SEQID6      FFKKWNPGANAYQLPGASEMSFEGGVSQSAYNTLASLKLPKPEQGPETINKVTEHKMSVE
SEQID8      FFKKWNPGANAYQLPGATEMSFEGGVSQSAYSTLASLKLPKPEQGPETINKVTEHKMSLE
SEQID9      FFKKWNPGANAYQLPGASEMSFEGGVSQSAYNTLASLKLPKPEQGPETINKVTEHKMSVE
SEQID11     FFKKWNPGANAYQLPGASEMSFEGGVSQSAYNTLASLDLPKPEQGPETINQVTEHKMSAE
SEQID7      FFKKWNPGANAYQLPGATEMSFEGGVSQSAYSTLASLKLPKPEQGPETINKVTEHKMSLE
SEQID13     FFKKWNPGANAYQLPGATEMSFEGGVSQSAYNTLASLDLPKPKQGPETINKVTEYSMPAE
SEQID15     FFKKWNPGANAYQLPGATEMSFEGGVSQSAYNTLASLDLPKPEQGPETINQVTEHKMSAE
SEQID2      FFKKWNPGASAYQLPGATEMSFQGGVSSSAYSTLASLKLPKPEKGPETINKVTEHKMSAE
SEQID10     FFKKWNPGANAYQLPGAAEMSFEGGVSSSAYSTLASLNLPKPEKGPETINKVTEHKMSAE
            *********.*******:** .*.****.***.***::.*.**::******:***:.*. *
PRIM.CONS.  FFKKWNPGANAYQLPGASEMSFEGGVSQSAYNTLASLDLPKPEQGPETINKVTEHKMSAE
```

FIGURE 2

| | 14 MG1655 | 13 RS218 | 2 APECO1 | 4 | 10 UTI89 | 3 | 12 | 5 | 16 | 8 | 7 | 6 | 9 | 11 | 15 | STRAINS |
|---|---|---|---|---|---|---|---|---|---|---|---|---|---|---|---|---|
| | 100 | 93,4 | 88 | 88 | 89,2 | 92,2 | 90,5 | 99,9 | 91,4 | 97,3 | 92,5 | 98,4 | 92,5 | 92,4 | 93,7 | DH10B |
| | 100 | 93,4 | 88 | 88 | 89,2 | 92,2 | 90,5 | 99,9 | 91,4 | 97,3 | 92,5 | 98,4 | 92,5 | 92,4 | 93,7 | MG1655 |
| | | 93,4 | 88 | 88 | 89,2 | 92,2 | 90,5 | 99,9 | 91,4 | 97,3 | 92,5 | 98,4 | 92,5 | 92,4 | 93,7 | 14 |
| | | | 87,6 | 87,6 | 88,9 | 89,7 | 89,6 | 93,4 | 90,8 | 92,3 | 93,6 | 92,2 | 93,2 | 93,9 | 99,6 | 13 |
| | | | 87,6 | 90,2 | 87,6 | 86,6 | 86,1 | 88 | 89,6 | 88,2 | 87,9 | 87,8 | 86,7 | 87,7 | 86,7 | RS218 |
| | | | | 100 | 87,6 | 86,6 | 86,2 | 88 | 89,6 | 88,2 | 87,9 | 87,8 | 86,7 | 87,8 | 87,7 | 2 |
| | | | | 100 | 87,6 | 86,6 | 86,2 | 88 | 89,6 | 88,2 | 87,9 | 87,8 | 86,7 | 87,8 | 87,7 | APECO1 |
| | | | | | 86,9 | 98,3 | 94,4 | 92,1 | 91,3 | 92 | 88,1 | 91,9 | 88,7 | 87,1 | 89,9 | 4 |
| | | | | | 85,9 | 86,6 | 86,2 | 88 | 89,6 | 88,2 | 87,9 | 86,7 | 87,1 | 87,8 | 87,7 | UTI89 |
| | | | | | | 94,1 | 86,7 | 89,1 | 88,1 | 89 | 89,4 | 88,8 | 87,1 | 88,2 | 89,1 | 10 |
| | | | | | | | 86,9 | 92,1 | 91,6 | 92 | 88,2 | 91,9 | 88,7 | 87,3 | 89,9 | 3 |
| | | | | | | | | 94,9 | 90,5 | 89,5 | 87,9 | 90,2 | 88,8 | 87,7 | 89,2 | 12 |
| | | | | | | | | | 91,3 | 97,2 | 92,4 | 98,4 | 92,4 | 89,9 | 93,6 | 5 |
| | | | | | | | | | | 91,3 | 88,9 | 91,5 | 98,6 | 89,9 | 92,4 | 90,6 | 16 |
| | | | | | | | | | | | 94,5 | 93,7 | 92,4 | 89,9 | 88,8 | 92,4 | 8 |
| | | | | | | | | | | | | 93,7 | 94,3 | 95,0 | 93,7 | 7 |
| | | | | | | | | | | | | | 93,7 | 91,2 | 92,3 | 6 |
| | | | | | | | | | | | | | | 96,4 | 93,3 | 9 |
| | | | | | | | | | | | | | | | 94,1 | 11 |

ESCHERICHIA COLI IMMUNOGENS WITH IMPROVED SOLUBILITY

CROSS REFERENCE TO RELATED APPLICATIONS

This application is a U.S. National Phase patent application of PCT/IB2009/000440, filed Feb. 23, 2009, which claims priority to Italian patent application Serial No. MI2008A001249, filed Jul. 9, 2008, and U.S. Provisional patent application Ser. No. 61/030,902, filed Feb. 22, 2008, all of which are hereby incorporated by reference in the present disclosure in their entirety.

This application claims priority from (i) U.S. Provisional Application 61/030902, filed 22 Feb. 2008 and (ii) Italian patent application MI2008A001249, filed 9 Jul. 2008, the contents of both of which are incorporated herein in full by reference.

The content of the following submission on ASCII text file is incorporated herein by reference in its entirety: a computer readable form (CRF) of the Sequence Listing (file name: 223002106900SubSeqList.txt, date recorded: Nov. 9, 2010, size: 747 KB).

TECHNICAL FIELD

This invention relates to immunisation against pathogenic *Escherichia coli* strains.

BACKGROUND ART

*E. coli* strains have traditionally been classified as either commensal or pathogenic, and pathogenic strains are then sub-classified as intestinal or extraintestinal strains. Pathogenic *E. coli* are discussed in more detail in reference 1, and fall into a number of different pathotypes i.e. a group of *E. coli* strains that cause a common disease using a common set of virulence factors. Pathotyping of strains is a routine technique that can be performed genotypically or phenotypically. One recent genotype-based pathotyping method [2] uses a DNA microarray.

Among intestinal strains at least six well-described pathotypes are known: enteropathogenic (EPEC), enterohaemorrhagic (EHEC), enteroaggregative (EAEC), enteroinvasive (EIEC), enterotoxigenic (ETEC) and diffusely adherent (DAEC).

The extraintestinal pathogenic strains (or 'ExPEC' strains [3,4]) of *E. coli* include uropathogenic (UPEC) strains, neonatal meningitis (NMEC) strains, and septicemia-associated strains (SEPEC). ExPEC is the most common cause of urinary tract infections and one of the leading causes of neonatal meningitis and neonatal sepsis in humans, which can lead to serious complications and death. Other types of extraintestinal infections include osteomyelitis, pulmonary, intra-abdominal, soft tissue, and intravascular device-associated infections. Another ExPEC pathotype outside humans is avian pathogenic (APEC), causing extraintestinal infections in poultry.

Most previous ExPEC vaccines have been based on cell lysates or on cellular structures. SOLCOUROVAC™ includes ten different heat-killed bacteria including six ExPEC strains. URO-VAXOM™ is an oral tablet vaccine containing lyophilised bacterial lysates of 18 selected *E. coli* strains. Baxter Vaccines developed a UTI vaccine based on pili from 6 to 10 different strains. MedImmune developed a product called MEDI 516 based on the FimH adhesin complex. In contrast, references 5 and 6 discloses specific immunogens from ExPEC strains that can be used as the basis of defined vaccines against both NMEC and UPEC strains.

It is an object of the invention to provide further and better antigens for use in immunisation against pathogenic *E. coli* strains, and more particularly against intestinal pathotypes (e.g. EAEC, EIEC, EPEC and ETEC strains) as well as ExPEC pathotypes.

DISCLOSURE OF THE INVENTION

One of the many antigens disclosed in reference 5 is annotated as the accessory colonization factor D (AcfD) precursor (SEQ ID NOs: 7051 & 7052 therein; SEQ ID NOs: 1 & 2 herein). Reference 5 discloses the sequence from NMEC strain IHE3034, and the present invention is based on variants of the ExPEC 'AcfD precursor' that have been identified in further pathotypes, including APEC, UPEC, EAEC, EIEC, EPEC and ETEC strains. Unlike the disclosure of reference 5, these variants can be particularly useful for treating intestinal pathotypes. Thus the invention provides such variants, together with their use in immunising patients against *E. coli* infections. In addition, this disclosure includes fragments of the AcfD protein of all *E. coli* pathotypes where the fragment has increased solubility as compared to the full length while raising a substantially similar immune response in a subject as that raised by the full length protein.

Polypeptides Used with the Invention

The invention provides a polypeptide comprising an amino acid sequence that:

(a) is identical (i.e. 100% identical) to any one of SEQ ID NOs 3 to 16;

(b) has at least a % sequence identity to one or more of SEQ ID NOs 3 to 16;

(c) is a fragment of at least b consecutive amino acids of one or more of SEQ ID NOs 3 to 16;

(d) has 1, 2, 3, 4, 5, 6, 7, 8, 9 or 10 (or more) single amino acid alterations (deletions, insertions, substitutions), which may be at separate locations or may be contiguous, as compared to the sequences of (a) or (b); and/or (e) when aligned with any one of SEQ ID NOs 3 to 16 using a pairwise alignment algorithm, each moving window of x amino acids from N-terminus to C-terminus (such that for an alignment that extends to p amino acids, where p>x, there are p−x+1 such windows) has at least x·y identical aligned amino acids, where: x is selected from 20, 25, 30, 35, 40, 45, 50, 60, 70, 80, 90, 100, 150, 200; y is selected from 0.50, 0.60, 0.70, 0.75, 0.80, 0.85, 0.90, 0.91, 0.92, 0.93, 0.94, 0.95, 0.96, 0.97, 0.98, 0.99; and if x·y is not an integer then it is rounded up to the nearest integer. The preferred pairwise alignment algorithm is the Needleman-Wunsch global alignment algorithm [7], using default parameters (e.g. with Gap opening penalty=10.0, and with Gap extension penalty=0.5, using the EBLOSUM62 scoring matrix). This algorithm is conveniently implemented in the needle tool in the EMBOSS package [8].

These polypeptides include variants of SEQ ID NOs 3 to 16, including allelic variants, polymorphic forms, homologs, orthologs, paralogs, mutants, etc.

The value of a may be selected from 50%, 60%, 65%, 70%, 75%, 80%, 85%, 87.5%, 90%, 91%, 92%, 93%, 94%, 95%, 96%, 97%, 98%, 99%, 99.5% or more.

The value of b may be selected from 7, 8, 9, 10, 12, 14, 16, 18, 20, 25, 30, 35, 40, 50, 60, 70, 80, 90, 100, 150, 200, 250 or more. Preferred fragments of comprise an epitope or immunogenic fragment from SEQ ID NOs 3 to 16. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NOs 3 to 16, preferably while retaining at least one epitope or immunogenic fragment of SEQ ID NOs 3 to 16. Other fragments omit one or more protein domains e.g. omission of a signal peptide, of a cytoplasmic domain, of a transmembrane domain, of an extracellular domain, etc. A deletion at the N-terminus, up to and including the GGGSG sequence (i.e. for SEQ ID NO: 3, deletion of amino acids of amino acids 1 to 30), provides a useful fragment (see, e.g., SEQ ID NOs 99-113. As demonstrated herein, such deletions increase the solubility of the AcfD polypeptide while retaining substantially the same immunogenicity.

Another useful fragment of the invention is formed by cleavage of one of SEQ ID NOs: 3 to 16 around its Arg-rich region (e.g. residues 770-775 of SEQ ID NO: 3). For instance, one such fragment has, at or within 20 amino acids of its C-terminus, a sequence having at least a % identity to amino acids 760-769 of SEQ ID NO: 3; another such fragment has, at or within 20 amino acids of its N-terminus, a sequence having at least a % identity to amino acids 776-785 of SEQ ID NO: 3. Fragments downstream of the Arg-rich region are particularly useful.

The invention also provides a polypeptide comprising an amino acid sequence that:
(a) is identical (i.e. 100% identical) to any one of SEQ ID NOs 3 to 16, SEQ ID NOs 99-113, or SEQ ID NOs 114-128;
(b) has at least a % sequence identity to one or more of SEQ ID NOs 3 to 16, SEQ ID NOs 99-113, or SEQ ID NOs 114-128;
(c) is a fragment of at least b consecutive amino acids of one or more of SEQ ID NOs 3 to 16, SEQ ID NOs 99-113, or SEQ ID NOs 114-128;
(d) has 1, 2, 3, 4, 5, 6, 7, 8, 9 or 10 (or more) single amino acid alterations (deletions, insertions, substitutions), which may be at separate locations or may be contiguous, as compared to the sequences of (a) or (b); and/or
(e) when aligned with any one of SEQ ID NOs 3 to 16, SEQ ID NOs 99-113, or SEQ ID NOs 114-128 using a pairwise alignment algorithm, each moving window of x amino acids from N-terminus to C-terminus (such that for an alignment that extends to p amino acids, where p>x, there are p−x+1 such windows) has at least x·y identical aligned amino acids, where: x is selected from 20, 25, 30, 35, 40, 45, 50, 60, 70, 80, 90, 100, 150, 200; y is selected from 0.50, 0.60, 0.70, 0.75, 0.80, 0.85, 0.90, 0.91, 0.92, 0.93, 0.94, 0.95, 0.96, 0.97, 0.98, 0.99; and if x·y is not an integer then it is rounded up to the nearest integer. The preferred pairwise alignment algorithm is the Needleman-Wunsch global alignment algorithm [9], using default parameters (e.g. with Gap opening penalty=10.0, and with Gap extension penalty=0.5, using the EBLOSUM62 scoring matrix). This algorithm is conveniently implemented in the needle tool in the EMBOSS package [10].

These polypeptides include variants of SEQ ID NOs 3 to 16, SEQ ID NOs 99-113, and SEQ ID NOs 114-128, including allelic variants, polymorphic forms, homologs, orthologs, paralogs, mutants, etc.

The value of a may be selected from 50%, 60%, 65%, 70%, 75%, 80%, 85%, 87.5%, 90%, 91%, 92%, 93%, 94%, 95%, 96%, 97%, 98%, 99%, 99.5% or more.

The value of b may be selected from 7, 8, 9, 10, 12, 14, 16, 18, 20, 25, 30, 35, 40, 50, 60, 70, 80, 90, 100, 150, 200, 250 or more. Preferred fragments of comprise an epitope or immunogenic fragment from SEQ ID NOs 3 to 16, SEQ ID NOs 99-113, and SEQ ID NOs 114-128. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NOs 3 to 16, SEQ ID NOs 99-113, or SEQ ID NOs 114-128, preferably while retaining at least one epitope or immunogenic fragment of SEQ ID NOs 3 to 16, SEQ ID NOs 99-113, or SEQ ID NOs 114-128. Other fragments omit one or more protein domains e.g. omission of a signal peptide, of a cytoplasmic domain, of a transmembrane domain, of an extracellular domain, etc. A deletion at the N-terminus, up to and including the GGGSG sequence (i.e. for SEQ ID NO: 3, deletion of amino acids of amino acids 1 to 30), provides a useful fragment (see, e.g., SEQ ID NOs 99-113. Deletion of about 90 amino acids at the N-terminus, to remove the proline-rich region, is also useful (see, e.g., SEQ ID NOs 114-128). As demonstrated herein, such deletions increase the solubility of the AcfD polypeptide while retaining substantially the same immunogenicity.

An epitope within a fragment may be a B-cell epitope and/or a T-cell epitope. Such epitopes can be identified empirically (e.g. using PEPSCAN [11,12] or similar methods), or they can be predicted (e.g. using the Jameson-Wolf antigenic index [13], matrix-based approaches [14], MAP-ITOPE [15], TEPITOPE [16,17], neural networks [18], Opti-Mer & EpiMer [19, 20], ADEPT [21], Tsites [22], hydrophilicity [23], antigenic index [24] or the methods disclosed in references 25-29, etc.). Epitopes are the parts of an antigen that are recognised by and bind to the antigen binding sites of antibodies or T-cell receptors, and they may also be referred to as "antigenic determinants".

Immunogenic fragments of SEQ ID NOs 3 to 16 discussed above include, without limitation, immunogenic fragments that, when administered to a subject in a suitable composition which can include an adjuvant (including without limitation any of the adjuvants listed or discussed in the section "Immunogenic compositions and medicaments" below), or a suitable carrier coupled to the polypeptide, induces an antibody or T-cell mediated immune response that recognizes the isolated full length polypeptide SEQ ID NOs 3 to 16, respectively, from which the immunogenic fragment is derived.

Particularly useful fragments include, but are not limited to, SEQ ID NOs: 17 to 95.

Immunogenic fragments of SEQ ID NOs 3 to 16, SEQ ID NOs 99-113, or SEQ ID NOs 114-128 discussed above include, without limitation, immunogenic fragments that, when administered to a subject in a suitable composition which can include an adjuvant (including without limitation any of the adjuvants listed or discussed in the section "Immunogenic compositions and medicaments" below), or a suitable carrier coupled to the polypeptide, induces an antibody or T-cell mediated immune response that recognizes the isolated full length polypeptide SEQ ID NOs 3 to 16, SEQ ID NOs 99-113, or SEQ ID NOs 114-128, respectively, from which the immunogenic fragment is derived.

Immunogenic fragments of SEQ ID NOs 3 to 16, SEQ ID NOs 99-113, or SEQ ID NOs 114-131, SEQ ID NOs 133-135, or SEQ ID NOs 137-139 include, without limitation, immunogenic fragments that, when administered to a subject in a suitable composition which can include an adjuvant (including without limitation any of the adjuvants listed or discussed in the section "Immunogenic compositions and medicaments" below), or a suitable carrier coupled to the polypeptide, induces an antibody or T-cell mediated immune response that recognizes the isolated full length polypeptide SEQ ID NOs 3 to 16, SEQ ID NOs 99-113, or SEQ ID NOs 114-131, SEQ ID NOs 133-135, or SEQ ID NOs 137-139, respectively, from which the immunogenic fragment is derived.

A polypeptide of the invention may, compared to any one of SEQ ID NOs 3 to 16, include one or more (e.g. 1, 2, 3, 4, 5, 6, 7, 8, 9, etc.) amino acid substitutions, such as conservative substitutions (i.e. substitutions of one amino acid with another which has a related side chain). Genetically-encoded amino acids are generally divided into four families: (1) acidic i.e. aspartate, glutamate; (2) basic i.e. lysine, arginine, histidine; (3) non-polar i.e. alanine, valine, leucine, isoleucine, proline, phenylalanine, methionine, tryptophan; and (4) uncharged polar i.e. glycine, asparagine, glutamine, cysteine, serine, threonine, tyrosine. Phenylalanine, tryptophan, and tyrosine are sometimes classified jointly as aromatic amino acids. In general, substitution of single amino acids within these families does not have a major effect on the biological activity.

A polypeptide of the invention may also, compared to any one of SEQ ID NOs 3 to 16, SEQ ID NOs 99-113, or SEQ ID NOs 114-128, include one or more (e.g. 1, 2, 3, 4, 5, 6, 7, 8, 9, etc.) amino acid substitutions, such as conservative substitutions (i.e. substitutions of one amino acid with another which has a related side chain). Genetically-encoded amino acids are generally divided into four families: (1) acidic i.e. aspartate, glutamate; (2) basic i.e. lysine, arginine, histidine; (3) non-polar i.e. alanine, valine, leucine, isoleucine, proline, phenylalanine, methionine, tryptophan; and (4) uncharged polar i.e. glycine, asparagine, glutamine, cysteine, serine, threonine, tyrosine. Phenylalanine, tryptophan, and tyrosine are sometimes classified jointly as aromatic amino acids. In general, substitution of single amino acids within these families does not have a major effect on the biological activity.

A polypeptide of the invention may additionally, compared to any one of SEQ ID NOs 3 to 16, SEQ ID NOs 99-113, SEQ ID NOs 114-128, SEQ ID NOs 129-131 SEQ ID NOs 133-135, or SEQ ID NOs 137-139, include one or more (e.g. 1, 2, 3, 4, 5, 6, 7, 8, 9, etc.) amino acid substitutions, such as conservative substitutions (i.e. substitutions of one amino acid with another which has a related side chain). Genetically-encoded amino acids are generally divided into four families: (1) acidic i.e. aspartate, glutamate; (2) basic i.e. lysine, arginine, histidine; (3) non-polar i.e. alanine, valine, leucine, isoleucine, proline, phenylalanine, methionine, tryptophan; and (4) uncharged polar i.e. glycine, asparagine, glutamine, cysteine, serine, threonine, tyrosine. Phenylalanine, tryptophan, and tyrosine are sometimes classified jointly as aromatic amino acids. In general, substitution of single amino acids within these families does not have a major effect on the biological activity.

A polypeptide may include one or more (e.g. 1, 2, 3, 4, 5, 6, 7, 8, 9, etc.) single amino acid deletions relative to any one of SEQ ID NOs 3 to 16. Similarly, a polypeptides may include one or more (e.g. 1, 2, 3, 4, 5, 6, 7, 8, 9, etc.) insertions (e.g. each of 1, 2, 3, 4 or 5 amino acids) relative to any one of SEQ ID NOs 3 to 16.

A polypeptide may also include one or more (e.g. 1, 2, 3, 4, 5, 6, 7, 8, 9, etc.) single amino acid deletions relative to any one of SEQ ID NOs 3 to 16, SEQ ID NOs 99-113, or SEQ ID NOs 114-128. Similarly, a polypeptides may include one or more (e.g. 1, 2, 3, 4, 5, 6, 7, 8, 9, etc.) insertions (e.g. each of 1, 2, 3, 4 or 5 amino acids) relative to any one of SEQ ID NOs 3 to 16.

A polypeptide may additionally include one or more (e.g. 1, 2, 3, 4, 5, 6, 7, 8, 9, etc.) single amino acid deletions relative to any one of SEQ ID NOs 3 to 16, SEQ ID NOs 99-113, or SEQ ID NOs 114-128, SEQ ID NOs 129-131, SEQ ID NOs 133-135, or SEQ ID NOs 137-139. Similarly, a polypeptides may include one or more (e.g. 1, 2, 3, 4, 5, 6, 7, 8, 9, etc.) insertions (e.g. each of 1, 2, 3, 4 or 5 amino acids) relative to any one of SEQ ID NOs 3 to 16, 129, 133, or 137.

Within group (c) of either of the above, deletions or substitutions may be at the N-terminus and/or C-terminus, or may be between the two termini. Thus a truncation is an example of a deletion. Truncations may involve deletion of up to 40 (or more) amino acids at the N-terminus and/or C-terminus. As mentioned above, for instance, truncation to remove the N-terminus up to the GGGSG sequence can be used.

In general, when a polypeptide of the invention comprises a sequence that is not identical to a complete one of SEQ ID NOs 3 to 16 (e.g. when it comprises a sequence with <100% sequence identity thereto, or when it comprises a fragment thereof) it is preferred that the polypeptide can elicit an antibody that recognises a polypeptide consisting of the complete SEQ ID sequence i.e. the antibody binds to one or more of said SEQ ID NOs 3 to 16. Such antibody may bind specifically to SEQ ID NOs 3 to 16, respectively while not binding to non-AcfD proteins with affinity significantly higher than the antibody's non-specific affinity to human serum albumin as a non-specific binding reference standard.

Similarly, when a polypeptide of the invention comprises a sequence that is not identical to a complete one of SEQ ID NOs 3 to 16, SEQ ID NOs 99-113, or SEQ ID NOs 114-128 (e.g. when it comprises a sequence with <100% sequence identity thereto, or when it comprises a fragment thereof) it is preferred that the polypeptide can elicit an antibody that recognises a polypeptide consisting of the complete SEQ ID sequence i.e. the antibody binds to one or more of said SEQ ID NOs 3 to 16, SEQ ID NOs 99-113, or SEQ ID NOs 114-128. Such antibody may bind specifically to SEQ ID NOs 3 to 16, SEQ ID NOs 99-113, or SEQ ID NOs 114-128, respectively while not binding to non-AcfD proteins with affinity significantly higher than the antibody's non-specific affinity to human serum albumin as a non-specific binding reference standard.

Additionally, when a polypeptide of the invention comprises a sequence that is not identical to a complete one of SEQ ID NOs 3 to 16, SEQ ID NOs 99-113, SEQ ID NOs 114-128, SEQ ID NOs 129-131 SEQ ID NOs 133-135, or SEQ ID NOs 137-139 (e.g. when it comprises a sequence with <100% sequence identity thereto, or when it comprises a fragment thereof) it is preferred that the polypeptide can elicit an antibody that recognises a polypeptide consisting of the complete SEQ ID sequence i.e. the antibody binds to one or more of said SEQ ID NOs 3 to 16, SEQ ID NOs 99-113, SEQ ID NOs 114-128, SEQ ID NOs 129-131, SEQ ID NOs 133-135, or SEQ ID NOs 137-139. Such antibody may bind specifically to SEQ ID NOs 3 to 16, SEQ ID NOs 99-113, SEQ ID NOs 114-128, SEQ ID NOs 129-131 SEQ ID NOs 133-135, or SEQ ID NOs 137-139, respectively while not binding to non-AcfD proteins with affinity significantly higher than the antibody's non-specific affinity to human serum albumin as a non-specific binding reference standard.

In one embodiment, the invention provides a polypeptide comprising an amino acid sequence: (a) having at least a % identity to any one of SEQ ID NOs 3 to 16; and (b) comprising a fragment of at least b consecutive amino acids of said SEQ ID.

In another embodiment, the invention provides a polypeptide comprising an amino acid sequence: (a) having at least a % identity to any one of SEQ ID NOs 3 to 16, SEQ ID NOs 99-113, or SEQ ID NOs 114-128; and (b) comprising a fragment of at least b consecutive amino acids of said SEQ ID.

In yet another embodiment, the invention provides a polypeptide comprising an amino acid sequence: (a) having at least a % identity to any one of SEQ ID NOs 3 to 16, SEQ ID NOs 99-113, SEQ ID NOs 114-128, SEQ ID NOs 129-131, SEQ ID NOs 133-135, or SEQ ID NOs 137-139; and (b) comprising a fragment of at least b consecutive amino acids of said SEQ ID.

A polypeptide of the invention may include a metal ion e.g. a metal ion that is coordinated by one or more amino acids in the polypeptide chain. For instance, the polypeptide may include a monovalent, divalent or trivalent metal cation. Divalent cations are typical, such as $Mn^{2+}$, $Fe^{2+}$, $Co^{2+}$, $Ni^{2+}$, $Cu^{2+}$, etc. The divalent cation is preferably $Zn^{2+}$. The ion may be coordinated by a HEAGH or HEVGH amino acid sequence.

Polypeptides used with the invention can take various forms (e.g. native, fusions, glycosylated, non-glycosylated, lipidated, non-lipidated, phosphorylated, non-phosphorylated, myristoylated, non-myristoylated, monomeric, multimeric, particulate, denatured, etc.). For instance, a polypeptide of the invention may have a lipidated N-terminal cysteine (e.g. Cys-24 of SEQ ID NOs: 3 to 16). Polypeptides used with the invention can be prepared by various means (e.g. recombinant expression, purification from cell culture, chemical synthesis, etc.). Recombinantly-expressed proteins are preferred.

Polypeptides used with the invention are preferably provided in purified or substantially purified form i.e. substantially free from other polypeptides (e.g. free from naturally-occurring polypeptides), particularly from other E. coli or host cell polypeptides, and are generally at least about 50% pure (by weight), and usually at least about 90% pure i.e. less than about 50%, and more preferably less than about 10% (e.g. 5%) of a composition is made up of other expressed polypeptides. Thus the antigens in the compositions are separated from the whole organism with which the molecule is expressed.

Polypeptides used with the invention are preferably E. coli polypeptides. Such polypeptides may be further selected from NMEC, APEC, UPEC, EAEC, EIEC, EPEC and ETEC E. coli polypeptides.

The term "polypeptide" refers to amino acid polymers of any length. The polymer may be linear or branched, it may comprise modified amino acids, and it may be interrupted by non-amino acids. The terms also encompass an amino acid polymer that has been modified naturally or by intervention; for example, disulfide bond formation, glycosylation, lipidation, acetylation, phosphorylation, or any other manipulation or modification, such as conjugation with a labeling component. Also included are, for example, polypeptides containing one or more analogs of an amino acid (including, for example, unnatural amino acids, etc.), as well as other modifications known in the art. Polypeptides can occur as single chains or associated chains.

The invention provides polypeptides comprising a sequence —P-Q- or -Q-P—, wherein: —P— is an amino acid sequence as defined above and -Q- is not a sequence as defined above i.e. the invention provides fusion proteins. Where the N-terminus codon of —P— is not ATG, but this codon is not present at the N-terminus of a polypeptide, it will be translated as the standard amino acid for that codon rather than as a Met. Where this codon is at the N-terminus of a polypeptide, however, it will be translated as Met. Examples of -Q- moieties include, but are not limited to, histidine tags (i.e. $His_n$ where n=3, 4, 5, 6, 7, 8, 9, 10 or more), a maltose-binding protein, or glutathione-S-transferase (GST).

The invention also provides an oligomeric protein comprising a polypeptide of the invention. The oligomer may be a dimer, a trimer, a tetramer, etc. The oligomer may be a homo-oligomer or a hetero-oligomer. Polypeptides in the oligomer may be covalently or non-covalently associated.

The invention also provides E. coli polypeptides which are fragments of the full length AcfD (of which SEQ ID NOs 2-16 are representative examples) which have increased solubility over the full length protein while raising a substantially similar immune response in a subject as that raised by the full length protein. Examples of such immunogenic polypeptide fragments include any of SEQ ID NOs 99-128. Increased solubility may be measured by any means available to one of skill in the art. One simple method involves overexpression of the fragment in bacteria and running comparative samples of total bacterial lysate versus bacterial lysate supernatant after centrifugation or samples of bacterial lysate pellet after centrifugation versus samples of bacterial lysate supernatant after centrifugation. One of skill in the art would grow and express such immunogenic polypeptide fragments using standard techniques (e.g., transform BL21(DE3) bacteria with a pET21 expression vector expressing the fragment, grow the bacteria to 0.6 $OD_{600}$ in LB and induce with 1 mM IPTG, and culture for 3 hours after induction), Such samples may be run on SDS PAGE (e.g., 4-12% MOPS) and roughly quantified by scanning the resulting stained gel and measuring the relative size of the bands. The increased solubility as used herein is as determined at 25° C. Such increased solubility can be a 10% increase in soluble polypeptide, a 20% increase in soluble polypeptide, a 30% increase in soluble polypeptide, a 50% increase in soluble polypeptide, a 75% increase in soluble polypeptide, a 100% increase (i.e., two-fold) in soluble polypeptide, a three-fold increase in soluble polypeptide, a four-fold increase in soluble polypeptide, a five-fold increase in soluble polypeptide, a seven-fold increase in soluble polypeptide, or a ten-fold increase in soluble polypeptide.

The invention additional provides E. coli polypeptides that are fragments of less than the full length AcfD (of which SEQ ID NOs 2-16 are representative examples). These less than full length fragment have increased solubility as compare to the full length protein while raising a substantially similar immune response in a subject as compared to that raised by the full length protein. Examples of such immunogenic polypeptide fragments include any of SEQ ID NOs 99-128. Increased solubility may be measured by any means available to one of skill in the art. One simple method involves overexpression of the fragment in bacteria and running comparative samples of total bacterial lysate versus bacterial lysate supernatant after centrifugation or samples of bacterial lysate pellet after centrifugation versus samples of bacterial lysate supernatant after centrifugation. One of skill in the art would grow and express such immunogenic polypeptide fragments using standard techniques (e.g., transform BL21(DE3) bacteria with a pET21 expression vector expressing the fragment, grow the bacteria to 0.6 $OD_{600}$ in LB and induce with 1 mM IPTG, and culture for 3 hours after induction). Such samples may be run on SDS PAGE (e.g., 4-12% MOPS) and roughly quantified by scanning the resulting stained gel and measuring the relative size of the bands. The increased solubility as used herein is as determined at 25° C. Such increased solubility can be a 10% increase in soluble polypeptide, a 20% increase in soluble polypeptide, a 30% increase in soluble polypeptide, a 50% increase in soluble polypeptide, a 75% increase in soluble polypeptide, a 100% increase (i.e., two-fold) in soluble polypeptide, a three-fold increase in soluble polypeptide, a four-fold increase in soluble polypeptide, a five-fold increase in soluble polypeptide, a seven-fold increase in soluble polypeptide, or a ten-fold increase in soluble polypeptide in each case as compared between the less than full length polypeptide compared to the corresponding full length protein measured under the same conditions.

The invention additional provides *E. coli* polypeptides that are fragments of less than the full length AcfD (of which SEQ ID NOs 2-16, 129, 133, and 137 are representative examples). These less than full length fragment have increased solubility as compare to the full length protein while raising a substantially similar immune response in a subject as compared to that raised by the full length protein. Examples of such immunogenic polypeptide fragments include any of SEQ ID NOs 99-128, SEQ ID NOs 130-131, SED ID NOs 134-135, and SEQ ID NOs 138-139. Increased solubility may be measured by any means available to one of skill in the art. One simple method involves overexpression of the fragment in bacteria and running comparative samples of total bacterial lysate versus bacterial lysate supernatant after centrifugation or samples of bacterial lysate pellet after centrifugation versus samples of bacterial lysate supernatant after centrifugation. One of skill in the art would grow and express such immunogenic polypeptide fragments using standard techniques (e.g., transform BL21(DE3) bacteria with a pET21 expression vector expressing the fragment, grow the bacteria to 0.6 $OD_{600}$ in LB and induce with 1 mM IPTG, and culture for 3 hours after induction). Such samples may be run on SDS PAGE (e.g., 4-12% MOPS) and roughly quantified by scanning the resulting stained gel and measuring the relative size of the bands. The increased solubility as used herein is as determined at 25° C. Such increased solubility can be a 10% increase in soluble polypeptide, a 20% increase in soluble polypeptide, a 30% increase in soluble polypeptide, a 50% increase in soluble polypeptide, a 75% increase in soluble polypeptide, a 100% increase (i.e., two-fold) in soluble polypeptide, a three-fold increase in soluble polypeptide, a four-fold increase in soluble polypeptide, a five-fold increase in soluble polypeptide, a seven-fold increase in soluble polypeptide, or a ten-fold increase in soluble polypeptide in each case as compared between the less than full length polypeptide compared to the corresponding full length protein measured under the same conditions.

Comparison of the immune response raised in a subject by the polypeptide with the immune response raised by the full length protein may be carried out use by any means available to one of skill in the art. One simple method as used in the examples below involves immunization of a model subject such as mouse and then challenge with a lethal dose of *E. coli*. For proper comparison, one of skill in the art would naturally select the same adjuvant such as Freund's complete adjuvant. In such a test the immunogenic polypeptide fragments of the present invention will raise a substantially similar immune response in a subject (i.e., will provide substantially the same protection against the lethal challenge) if, for example, the polypeptide provides at least 70% of the protection provided by the full length protein, at least 80% of the protection provided by the full length protein, at least 85% of the protection provided by the full length protein, at least 90% of the protection provided by the full length protein, at least 95% of the protection provided by the full length protein, at least 97% of the protection provided by the full length protein, at least 98% of the protection provided by the full length protein, or at least 99% of the protection provided by the full length protein.

Furthermore, comparison between the immune response raised in a subject by the less than full length polypeptide and the immune response raised by the corresponding full length protein may be carried out use by any means available to one of skill in the art. One simple method as used in the examples below involves immunization of a model subject such as mouse and then challenge with a lethal dose of *E. coli*. For proper comparison, one of skill in the art would naturally select the same adjuvant such as Freund's complete adjuvant. In such a test the immunogenic less than full length polypeptide fragments of the present invention will raise a substantially similar immune response in a subject as compared to the immune response raised by the corresponding full length protein (i.e., will provide substantially the same protection against the lethal challenge) if, for example, the polypeptide provides at least 70% of the protection provided by the full length protein, at least 80% of the protection provided by the full length protein, at least 85% of the protection provided by the full length protein, at least 90% of the protection provided by the full length protein, at least 95% of the protection provided by the full length protein, at least 97% of the protection provided by the full length protein, at least 98% of the protection provided by the full length protein, or at least 99% of the protection provided by the full length protein.

The full length AcfD protein against which the immunogenic polypeptide fragment would be compared (for both solubility and immune response raised) may be any representative *E. coli* AcfD protein including without limitation SEQ ID NOs 2-16. In preferred embodiments, the AcfD protein will be the corresponding full length protein from which the immunogenic polypeptide fragment is obtained.

In some embodiments, the immunogenic polypeptide will contain a deletion relative to the *E. coli* AcfD protein which results in the increased solubility. The deletion may include removal of substantially all of the N-terminal amino acids up to the gly-ser linker or gly-ser region, removal of all or a part of the N-terminal proline-rich repeat, or both. One of skill in the art would understand the N-terminal amino acids up to the gly-ser linker or gly-ser region to correspond to the region of the *E. coli* AcfD protein of interest to be that portion of the protein that aligns to the region of the *E. coli* AcfD proteins identified herein which are denoted with a "G" under the alignment in FIG. 1. Similarly, one of skill in the art would understand the N-terminal proline-rich repeat to correspond to the region of the *E. coli* AcfD protein of interest to be that portion of the protein that aligns to the region of the *E. coli* AcfD proteins identified herein which are denoted with a "P" under the alignment in FIG. 1.

In certain aspects, the immunogenic polypeptide fragment may be a fragment which comprises SEQ ID NOs 99 or 114 (including any fragment encompassing SEQ ID NO: 114 with an N-terminus between the N-terminus of SEQ ID NOs 99 and 114) provided that the immunogenic polypeptide fragment does not have the amino acid sequence of SEQ ID NO 2. The immunogenic polypeptide fragment may be a fragment which comprises SEQ ID NOs 100 or 115 (including any fragment encompassing SEQ ID NO: 115 with an N-terminus between the N-terminus of SEQ ID NOs 100 and 115) provided that the immunogenic polypeptide fragment does not have the amino acid sequence of SEQ ID NO 3. The immunogenic polypeptide fragment may be a fragment which comprises SEQ ID NOs 101 or 116 (including any fragment encompassing SEQ ID NO: 116 with an N-terminus between the N-terminus of SEQ ID NOs 101 and 116) provided that the immunogenic polypeptide fragment does not have the amino acid sequence of SEQ ID NO 4. The immunogenic polypeptide fragment may be a fragment which comprises SEQ ID NOs 102 or 117 (including any fragment encompassing SEQ ID NO: 117 with an N-terminus between the N-terminus of SEQ ID NOs 102 and 117) provided that the immunogenic polypeptide fragment does not have the amino acid sequence of SEQ ID NO 5. The immunogenic polypeptide fragment may be a fragment which comprises SEQ ID NOs 103 or 118 (including any fragment encompassing SEQ ID NO: 118 with an N-terminus between the N-terminus of SEQ ID NOs 103 and 118) provided that the immunogenic polypeptide fragment does not have the amino acid sequence of SEQ ID NO 6. The immunogenic polypeptide fragment may be a fragment which comprises SEQ ID NOs 104 or 119 (including any fragment encompassing SEQ ID NO: 119 with an N-terminus between the N-terminus of SEQ ID NOs 104 and 119) provided that the immunogenic polypeptide fragment does not have the amino acid sequence of SEQ ID NO 7. The immunogenic polypeptide fragment may be a fragment which comprises SEQ ID NOs 105 or 120 (including any fragment encompassing SEQ ID NO: 120 with an N-terminus between the N-terminus of SEQ ID NOs 105 and 120) provided that the immunogenic polypeptide fragment does not have the amino acid sequence of SEQ ID NO 8. The immunogenic polypeptide fragment may be a fragment which comprises SEQ ID NOs 106 or 121 (including any fragment encompassing SEQ ID NO: 121 with an N-terminus between the N-terminus of SEQ ID NOs 106 and 121) provided that the immunogenic polypeptide fragment does not have the amino acid sequence of SEQ ID NO 9. The immunogenic polypeptide fragment may be a fragment which comprises SEQ ID NOs 107 or 122 (including any fragment encompassing SEQ ID NO: 122 with an N-terminus between the N-terminus of SEQ ID NOs 107 and 122) provided that the immunogenic polypeptide fragment does not have the amino acid sequence of SEQ ID NO 10. The immunogenic polypeptide fragment may be a fragment which comprises SEQ ID NOs 108 or 123 (including any fragment encompassing SEQ ID NO: 123 with an N-terminus between the N-terminus of SEQ ID NOs 108 and 123) provided that the immunogenic polypeptide fragment does not have the amino acid sequence of SEQ ID NO 11. The immunogenic polypeptide fragment may be a fragment which comprises SEQ ID NOs 109 or 124 (including any fragment encompassing SEQ ID NO: 124 with an N-terminus between the N-terminus of SEQ ID NOs 109 and 124) provided that the immunogenic polypeptide fragment does not have the amino acid sequence of SEQ ID NO 12. The immunogenic polypeptide fragment may be a fragment which comprises SEQ ID NOs 110 or 125 (including any fragment encompassing SEQ ID NO: 125 with an N-terminus between the N-terminus of SEQ ID NOs 110 and 125) provided that the immunogenic polypeptide fragment does not have the amino acid sequence of SEQ ID NO 13. The immunogenic polypeptide fragment may be a fragment which comprises SEQ ID NOs 111 or 126 (including any fragment encompassing SEQ ID NO: 126 with an N-terminus between the N-terminus of SEQ ID NOs 111 and 126) provided that the immunogenic polypeptide fragment does not have the amino acid sequence of SEQ ID NO 14. The immunogenic polypeptide fragment may be a fragment which comprises SEQ ID NOs 112 or 127 (including any fragment encompassing SEQ ID NO: 127 with an N-terminus between the N-terminus of SEQ ID NOs 112 and 127) provided that the immunogenic polypeptide fragment does not have the amino acid sequence of SEQ ID NO 15. The immunogenic polypeptide fragment may be a fragment which comprises SEQ ID NOs 113 or 128 (including any fragment encompassing SEQ ID NO: 128 with an N-terminus between the N-terminus of SEQ ID NOs 113 and 128) provided that the immunogenic polypeptide fragment does not have the amino acid sequence of SEQ ID NO 16. Any of the foregoing immunogenic polypeptide fragments may also include variations so long as the variations do not result in the immunogenic polypeptide having the sequence of any full length AcfD protein, including without limitation any of the variations listed in this section "Polypeptides used with the invention." Examples include: from 1 to 10 single amino acid alterations compared to the applicable SEQ ID NOs; at least 85% sequence identity to the applicable SEQ ID NOs; a fragment of at least 10 consecutive amino acids of the applicable SEQ ID NOs; and when aligned with the applicable SEQ ID NOs using a pairwise alignment algorithm, each moving window of x amino acids from N terminus to C terminus has at least x·y identical aligned amino acids, where x is 30 and y is 0.75.

The invention also provides a process for producing a polypeptide of the invention, comprising the step of culturing a host cell transformed with nucleic acid of the invention under conditions which induce polypeptide expression. The polypeptide may then be purified e.g. from culture supernatants.

The invention provides an *E. coli* cell, containing a plasmid that encodes a polypeptide of the invention. The chromosome of the *E. coli* cell may include a homolog of AcfD, or such a homolog may be absent, but in both cases the polypeptide of the invention can be expressed from the plasmid. The plasmid may include a gene encoding a marker, etc. These and other details of suitable plasmids are given below.

Although expression of the polypeptides of the invention may take place in an *E. coli* strain, the invention will usually use a heterologous host for expression. The heterologous host may be prokaryotic (e.g. a bacterium) or eukaryotic. Suitable hosts include, but are not limited to, *Bacillus subtilis, Vibrio cholerae, Salmonella typhi, Salmonella typhimurium, Neisseria lactamica, Neisseria cinerea, Mycobacteria* (e.g. *M. tuberculosis*), yeasts, etc.

The invention provides a process for producing a polypeptide of the invention, comprising the step of synthesising at least part of the polypeptide by chemical means.

Any and all of the foregoing proteins, polypeptides, hybrid polypeptides, epitopes and immunogenic fragments may be in any one of a number of forms including, without limitation, recombinant, isolated or substantially purified (from materials co-existing with such proteins, polypeptides, hybrid polypeptides, epitopes and immunogenic fragments in their natural state).

Nucleic Acids

The invention also provides nucleic acid encoding polypeptides and hybrid polypeptides of the invention. It also provides nucleic acid comprising a nucleotide sequence that encodes one or more polypeptides or hybrid polypeptides of the invention.

The invention also provides nucleic acid comprising nucleotide sequences having sequence identity to such nucleotide sequences. Identity between sequences is preferably determined by the Smith-Waterman homology search algorithm as described above. Such nucleic acids include those using alternative codons to encode the same amino acid.

The invention also provides nucleic acid which can hybridize to these nucleic acids. Hybridization reactions can be performed under conditions of different "stringency". Conditions that increase stringency of a hybridization reaction of widely known and published in the art (e.g. page 7.52 of reference 224). Examples of relevant conditions include (in order of increasing stringency): incubation temperatures of 25° C., 37° C., 50° C., 55° C. and 68° C.; buffer concentrations of 10×SSC, 6×SSC, 1×SSC, 0.1×SSC (where SSC is 0.15 M NaCl and 15 mM citrate buffer) and their equivalents using other buffer systems; formamide concentrations of 0%, 25%, 50%, and 75%; incubation times from 5 minutes to 24 hours; 1, 2, or more washing steps; wash incubation times of 1, 2, or 15 minutes; and wash solutions of 6×SSC, 1×SSC, 0.1×SSC, or de-ionized water. Hybridization techniques and their optimization are well known in the art (e.g. see refs 30, 31, 224, 226, etc.].

In some embodiments, nucleic acid of the invention hybridizes to a target under low stringency conditions; in other embodiments it hybridizes under intermediate stringency conditions; in preferred embodiments, it hybridizes under high stringency conditions. An exemplary set of low stringency hybridization conditions is 50° C. and 10×SSC. An exemplary set of intermediate stringency hybridization conditions is 55° C. and 1×SSC. An exemplary set of high stringency hybridization conditions is 68° C. and 0.1×SSC.

The invention includes nucleic acid comprising sequences complementary to these sequences (e.g. for antisense or probing, or for use as primers).

Nucleic acids of the invention can be used in hybridisation reactions (e.g. Northern or Southern blots, or in nucleic acid microarrays or 'gene chips') and amplification reactions (e.g. PCR, SDA, SSSR, LCR, TMA, NASBA, etc.) and other nucleic acid techniques.

Nucleic acid according to the invention can take various forms (e.g. single-stranded, double-stranded, vectors, primers, probes, labelled etc.). Nucleic acids of the invention may be circular or branched, but will generally be linear. Unless otherwise specified or required, any embodiment of the invention that utilizes a nucleic acid may utilize both the double-stranded form and each of two complementary single-stranded forms which make up the double-stranded form. Primers and probes are generally single-stranded, as are antisense nucleic acids.

Nucleic acids of the invention are preferably provided in purified or substantially purified form i.e. substantially free from other nucleic acids (e.g. free from naturally-occurring nucleic acids), particularly from other *E. coli* or host cell nucleic acids, generally being at least about 50% pure (by weight), and usually at least about 90% pure. Nucleic acids of the invention are preferably *E. coli* nucleic acids.

Nucleic acids of the invention may be prepared in many ways e.g. by chemical synthesis (e.g. phosphoramidite synthesis of DNA) in whole or in part, by digesting longer nucleic acids using nucleases (e.g. restriction enzymes), by joining shorter nucleic acids or nucleotides (e.g. using ligases or polymerases), from genomic or cDNA libraries, etc.

Nucleic acid of the invention may be attached to a solid support (e.g. a bead, plate, filter, film, slide, microarray support, resin, etc.). Nucleic acid of the invention may be labelled e.g. with a radioactive or fluorescent label, or a biotin label. This is particularly useful where the nucleic acid is to be used in detection techniques e.g. where the nucleic acid is a primer or as a probe.

The term "nucleic acid" includes in general means a polymeric form of nucleotides of any length, which contain deoxyribonucleotides, ribonucleotides, and/or their analogs. It includes DNA, RNA, DNA/RNA hybrids. It also includes DNA or RNA analogs, such as those containing modified backbones (e.g. peptide nucleic acids (PNAs) or phosphorothioates) or modified bases. Thus the invention includes mRNA, tRNA, rRNA, ribozymes, DNA, cDNA, recombinant nucleic acids, branched nucleic acids, plasmids, vectors, probes, primers, etc. Where nucleic acid of the invention takes the form of RNA, it may or may not have a 5' cap.

Nucleic acids of the invention may be part of a vector i.e. part of a nucleic acid construct designed for transduction/transfection of one or more cell types. Vectors may be, for example, "cloning vectors" which are designed for isolation, propagation and replication of inserted nucleotides, "expression vectors" which are designed for expression of a nucle-otide sequence in a host cell, "viral vectors" which is designed to result in the production of a recombinant virus or virus-like particle, or "shuttle vectors", which comprise the attributes of more than one type of vector. Preferred vectors are plasmids, as mentioned above. A "host cell" includes an individual cell or cell culture which can be or has been a recipient of exogenous nucleic acid. Host cells include progeny of a single host cell, and the progeny may not necessarily be completely identical (in morphology or in total DNA complement) to the original parent cell due to natural, accidental, or deliberate mutation and/or change. Host cells include cells transfected or infected in vivo or in vitro with nucleic acid of the invention.

Where a nucleic acid is DNA, it will be appreciated that "U" in a RNA sequence will be replaced by "T" in the DNA. Similarly, where a nucleic acid is RNA, it will be appreciated that "T" in a DNA sequence will be replaced by "U" in the RNA.

The term "complement" or "complementary" when used in relation to nucleic acids refers to Watson-Crick base pairing. Thus the complement of C is G, the complement of G is C, the complement of A is T (or U), and the complement of T (or U) is A. It is also possible to use bases such as I (the purine inosine) e.g. to complement pyrimidines (C or T).

Nucleic acids of the invention can be used, for example: to produce polypeptides; as hybridization probes for the detection of nucleic acid in biological samples; to generate additional copies of the nucleic acids; to generate ribozymes or antisense oligonucleotides; as single-stranded DNA primers or probes; or as triple-strand forming oligonucleotides.

The invention provides a process for producing nucleic acid of the invention, wherein the nucleic acid is synthesised in part or in whole using chemical means.

The invention provides vectors comprising nucleotide sequences of the invention (e.g. cloning or expression vectors) and host cells transformed with such vectors.

Nucleic acid amplification according to the invention may be quantitative and/or real-time.

For certain embodiments of the invention, nucleic acids are preferably at least 7 nucleotides in length (e.g. 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 55, 60, 65, 70, 75, 80, 90, 100, 110, 120, 130, 140, 150, 160, 170, 180, 190, 200, 225, 250, 275, 300 nucleotides or longer).

For certain embodiments of the invention, nucleic acids are preferably at most 500 nucleotides in length (e.g. 450, 400, 350, 300, 250, 200, 150, 140, 130, 120, 110, 100, 90, 80, 75, 70, 65, 60, 55, 50, 45, 40, 39, 38, 37, 36, 35, 34, 33, 32, 31, 30, 29, 28, 27, 26, 25, 24, 23, 22, 21, 20, 19, 18, 17, 16, 15 nucleotides or shorter).

Primers and probes of the invention, and other nucleic acids used for hybridization, are preferably between 10 and 30 nucleotides in length (e.g. 10, 11, 12, 13, 14, 15, 16, 17, 18, 19, 20, 21, 22, 23, 24, 25, 26, 27, 28, 29, or 30 nucleotides).

Immunogenic Compositions and Medicaments

Polypeptides of the invention are useful as active ingredients (immunogens) in immunogenic compositions, and such compositions may be useful as vaccines. Vaccines according to the invention may either be prophylactic (i.e. to prevent infection) or therapeutic (i.e. to treat infection), but will typically be prophylactic.

Immunogenic compositions will be pharmaceutically acceptable. They will usually include components in addition to the antigens e.g. they typically include one or more pharmaceutical carrier(s), excipient(s) and/or adjuvant(s). A thorough discussion of carriers and excipients is available in ref. 221. Thorough discussions of vaccine adjuvants are available in refs. 32 and 33.

Compositions will generally be administered to a mammal in aqueous form. Prior to administration, however, the composition may have been in a non-aqueous form. For instance, although some vaccines are manufactured in aqueous form, then filled and distributed and administered also in aqueous form, other vaccines are lyophilised during manufacture and are reconstituted into an aqueous form at the time of use. Thus a composition of the invention may be dried, such as a lyophilised formulation.

The composition may include preservatives such as thiomersal or 2-phenoxyethanol. It is preferred, however, that the vaccine should be substantially free from (i.e. less than 5 μg/ml) mercurial material e.g. thiomersal-free. Vaccines containing no mercury are more preferred. Preservative-free vaccines are particularly preferred.

To improve thermal stability, a composition may include a temperature protective agent.

To control tonicity, it is preferred to include a physiological salt, such as a sodium salt. Sodium chloride (NaCl) is preferred, which may be present at between 1 and 20 mg/ml e.g. about 10±2 mg/ml NaCl. Other salts that may be present include potassium chloride, potassium dihydrogen phosphate, disodium phosphate dehydrate, magnesium chloride, calcium chloride, etc.

Compositions will generally have an osmolality of between 200 mOsm/kg and 400 mOsm/kg, preferably between 240-360 mOsm/kg, and will more preferably fall within the range of 290-310 mOsm/kg.

Compositions may include one or more buffers. Typical buffers include: a phosphate buffer; a Tris buffer; a borate buffer; a succinate buffer; a histidine buffer (particularly with an aluminum hydroxide adjuvant); or a citrate buffer. Buffers will typically be included in the 5-20 mM range.

The pH of a composition will generally be between 5.0 and 8.1, and more typically between 6.0 and 8.0 e.g. 6.5 and 7.5, or between 7.0 and 7.8.

The composition is preferably sterile. The composition is preferably non-pyrogenic e.g. containing <1 EU (endotoxin unit, a standard measure) per dose, and preferably <0.1 EU per dose. The composition is preferably gluten free.

The composition may include material for a single immunisation, or may include material for multiple immunisations (i.e. a 'multidose' kit). The inclusion of a preservative is preferred in multidose arrangements. As an alternative (or in addition) to including a preservative in multidose compositions, the compositions may be contained in a container having an aseptic adaptor for removal of material.

Human vaccines are typically administered in a dosage volume of about 0.5 ml, although a half dose (i.e. about 0.25 ml) may be administered to children.

Immunogenic compositions of the invention may also comprise one or more immunoregulatory agents. Preferably, one or more of the immunoregulatory agents include one or more adjuvants. The adjuvants may include a TH1 adjuvant and/or a TH2 adjuvant, further discussed below.

Adjuvants which may be used in compositions of the invention include, but are not limited to:

A. Mineral-Containing Compositions

Mineral containing compositions suitable for use as adjuvants in the invention include mineral salts, such as aluminium salts and calcium salts (or mixtures thereof). Calcium salts include calcium phosphate (e.g. the "CAP" particles disclosed in ref. 34). Aluminum salts include hydroxides, phosphates, sulfates, etc., with the salts taking any suitable form (e.g. gel, crystalline, amorphous, etc.). Adsorption to these salts is preferred. The mineral containing compositions may also be formulated as a particle of metal salt [35].

The adjuvants known as aluminum hydroxide and aluminum phosphate may be used. These names are conventional, but are used for convenience only, as neither is a precise description of the actual chemical compound which is present (e.g. see chapter 9 of reference 32). The invention can use any of the "hydroxide" or "phosphate" adjuvants that are in general use as adjuvants. The adjuvants known as "aluminium hydroxide" are typically aluminium oxyhydroxide salts, which are usually at least partially crystalline. The adjuvants known as "aluminium phosphate" are typically aluminium hydroxyphosphates, often also containing a small amount of sulfate (i.e. aluminium hydroxyphosphate sulfate). They may be obtained by precipitation, and the reaction conditions and concentrations during precipitation influence the degree of substitution of phosphate for hydroxyl in the salt.

A fibrous morphology (e.g. as seen in transmission electron micrographs) is typical for aluminium hydroxide adjuvants. The pI of aluminium hydroxide adjuvants is typically about 11 i.e. the adjuvant itself has a positive surface charge at physiological pH. Adsorptive capacities of between 1.8-2.6 mg protein per mg $Al^{+++}$ at pH 7.4 have been reported for aluminium hydroxide adjuvants.

Aluminium phosphate adjuvants generally have a $PO_4/Al$ molar ratio between 0.3 and 1.2, preferably between 0.8 and 1.2, and more preferably 0.95±0.1. The aluminium phosphate will generally be amorphous, particularly for hydroxyphosphate salts. A typical adjuvant is amorphous aluminium hydroxyphosphate with $PO_4/Al$ molar ratio between 0.84 and 0.92, included at 0.6 mg $Al^{3+}$/ml. The aluminium phosphate will generally be particulate (e.g. plate-like morphology as seen in transmission electron micrographs). Typical diameters of the particles are in the range 0.5-20 μm (e.g. about 5-10 μm) after any antigen adsorption. Adsorptive capacities of between 0.7-1.5 mg protein per mg $Al^{+++}$ at pH 7.4 have been reported for aluminium phosphate adjuvants.

The point of zero charge (PZC) of aluminium phosphate is inversely related to the degree of substitution of phosphate for hydroxyl, and this degree of substitution can vary depending on reaction conditions and concentration of reactants used for preparing the salt by precipitation. PZC is also altered by changing the concentration of free phosphate ions in solution (more phosphate=more acidic PZC) or by adding a buffer such as a histidine buffer (makes PZC more basic). Aluminium phosphates used according to the invention will generally have a PZC of between 4.0 and 7.0, more preferably between 5.0 and 6.5 e.g. about 5.7.

Suspensions of aluminium salts used to prepare compositions of the invention may contain a buffer (e.g. a phosphate or a histidine or a Tris buffer), but this is not always necessary. The suspensions are preferably sterile and pyrogen-free. A suspension may include free aqueous phosphate ions e.g. present at a concentration between 1.0 and 20 mM, preferably between 5 and 15 mM, and more preferably about 10 mM. The suspensions may also comprise sodium chloride.

The invention can use a mixture of both an aluminium hydroxide and an aluminium phosphate. In this case there may be more aluminium phosphate than hydroxide e.g. a weight ratio of at least 2:1 e.g. ≧5:1, ≧6:1, ≧7:1, ≧8:1, ≧9:1, etc.

The concentration of $Al^{+++}$ in a composition for administration to a patient is preferably less than 10 mg/ml e.g. ≦5 mg/ml, ≦4 mg/ml, ≦3 mg/ml, ≦2 mg/ml, ≦1 mg/ml, etc. A preferred range is between 0.3 and 1 mg/ml. A maximum of 0.85 mg/dose is preferred.

B. Oil Emulsions

Oil emulsion compositions suitable for use as adjuvants in the invention include squalene-water emulsions, such as MF59 [Chapter 10 of ref. 32; see also ref. 36] (5% Squalene, 0.5% Tween 80, and 0.5% Span 85, formulated into submicron particles using a microfluidizer). Complete Freund's adjuvant (CFA) and incomplete Freund's adjuvant (IFA) may also be used.

Various oil-in-water emulsion adjuvants are known, and they typically include at least one oil and at least one surfactant, with the oil(s) and surfactant(s) being biodegradable (metabolisable) and biocompatible. The oil droplets in the emulsion are generally less than 5 μm in diameter, and ideally have a sub-micron diameter, with these small sizes being achieved with a microfluidiser to provide stable emulsions. Droplets with a size less than 220 nm are preferred as they can be subjected to filter sterilization.

The emulsion can comprise oils such as those from an animal (such as fish) or vegetable source. Sources for vegetable oils include nuts, seeds and grains. Peanut oil, soybean oil, coconut oil, and olive oil, the most commonly available, exemplify the nut oils. Jojoba oil can be used e.g. obtained from the jojoba bean. Seed oils include safflower oil, cottonseed oil, sunflower seed oil, sesame seed oil and the like. In the grain group, corn oil is the most readily available, but the oil of other cereal grains such as wheat, oats, rye, rice, teff, triticale and the like may also be used. 6-10 carbon fatty acid esters of glycerol and 1,2-propanediol, while not occurring naturally in seed oils, may be prepared by hydrolysis, separation and esterification of the appropriate materials starting from the nut and seed oils. Fats and oils from mammalian milk are metabolizable and may therefore be used in the practice of this invention. The procedures for separation, purification, saponification and other means necessary for obtaining pure oils from animal sources are well known in the art. Most fish contain metabolizable oils which may be readily recovered. For example, cod liver oil, shark liver oils, and whale oil such as spermaceti exemplify several of the fish oils which may be used herein. A number of branched chain oils are synthesized biochemically in 5-carbon isoprene units and are generally referred to as terpenoids. Shark liver oil contains a branched, unsaturated terpenoids known as squalene, 2,6,10,15,19,23-hexamethyl-2,6,10,14,18,22-tetracosahexaene, which is particularly preferred herein. Squalane, the saturated analog to squalene, is also a preferred oil. Fish oils, including squalene and squalane, are readily available from commercial sources or may be obtained by methods known in the art. Other preferred oils are the tocopherols (see below). Mixtures of oils can be used.

Surfactants can be classified by their 'HLB' (hydrophile/lipophile balance). Preferred surfactants of the invention have a HLB of at least 10, preferably at least 15, and more preferably at least 16. The invention can be used with surfactants including, but not limited to: the polyoxyethylene sorbitan esters surfactants (commonly referred to as the Tweens), especially polysorbate 20 and polysorbate 80; copolymers of ethylene oxide (EO), propylene oxide (PO), and/or butylene oxide (BO), sold under the DOWFAX™ tradename, such as linear EO/PO block copolymers; octoxynols, which can vary in the number of repeating ethoxy (oxy-1,2-ethanediyl) groups, with octoxynol-9 (Triton X-100, or t-octylphenoxypolyethoxyethanol) being of particular interest; (octylphenoxy)polyethoxyethanol (IGEPAL CA-630/NP-40); phospholipids such as phosphatidylcholine (lecithin); nonylphenol ethoxylates, such as the Tergitol™ NP series; polyoxyethylene fatty ethers derived from lauryl, cetyl, stearyl and oleyl alcohols (known as Brij surfactants), such as triethyleneglycol monolauryl ether (Brij 30); and sorbitan esters (commonly known as the SPANs), such as sorbitan trioleate (Span 85) and sorbitan monolaurate. Non-ionic surfactants are preferred. Preferred surfactants for including in the emulsion are Tween 80 (polyoxyethylene sorbitan monooleate), Span 85 (sorbitan trioleate), lecithin and Triton X-100.

Mixtures of surfactants can be used e.g. Tween 80/Span 85 mixtures. A combination of a polyoxyethylene sorbitan ester such as polyoxyethylene sorbitan monooleate (Tween 80) and an octoxynol such as t-octylphenoxypolyethoxyethanol (Triton X-100) is also suitable. Another useful combination comprises laureth 9 plus a polyoxyethylene sorbitan ester and/or an octoxynol.

Preferred amounts of surfactants (% by weight) are: polyoxyethylene sorbitan esters (such as Tween 80) 0.01 to 1%, in particular about 0.1%; octyl- or nonylphenoxy polyoxyethanols (such as Triton X-100, or other detergents in the Triton series) 0.001 to 0.1%, in particular 0.005 to 0.02%; polyoxyethylene ethers (such as laureth 9) 0.1 to 20%, preferably 0.1 to 10% and in particular 0.1 to 1% or about 0.5%.

Preferred emulsion adjuvants have an average droplets size of <1 μm e.g. ≦750 nm, ≦500 nm, ≦400 nm, ≦300 nm, ≦250 nm, ≦220 nm, ≦200 nm, or smaller. These droplet sizes can conveniently be achieved by techniques such as microfluidisation.

Specific oil-in-water emulsion adjuvants useful with the invention include, but are not limited to:

A submicron emulsion of squalene, Tween 80, and Span 85. The composition of the emulsion by volume can be about 5% squalene, about 0.5% polysorbate 80 and about 0.5% Span 85. In weight terms, these ratios become 4.3% squalene, 0.5% polysorbate 80 and 0.48% Span 85. This adjuvant is known as 'MF59' [37-39], as described in more detail in Chapter 10 of ref. 40 and chapter 12 of ref. 41. The MF59 emulsion advantageously includes citrate ions e.g. 10 mM sodium citrate buffer.

An emulsion of squalene, a tocopherol, and Tween 80. The emulsion may include phosphate buffered saline. It may also include Span 85 (e.g. at 1%) and/or lecithin. These emulsions may have from 2 to 10% squalene, from 2 to 10% tocopherol and from 0.3 to 3% Tween 80, and the weight ratio of squalene:tocopherol is preferably ≦1 as this provides a more stable emulsion. Squalene and Tween 80 may be present volume ratio of about 5:2. One such emulsion can be made by dissolving Tween 80 in PBS to give a 2% solution, then mixing 90 ml of this solution with a mixture of (5 g of DL-α-tocopherol and 5 ml squalene), then microfluidising the mixture. The resulting emulsion may have submicron oil droplets e.g. with an average diameter of between 100 and 250 nm, preferably about 180 nm.

An emulsion of squalene, a tocopherol, and a Triton detergent (e.g. Triton X-100). The emulsion may also include a 3d-MPL (see below). The emulsion may contain a phosphate buffer.

An emulsion comprising a polysorbate (e.g. polysorbate 80), a Triton detergent (e.g. Triton X-100) and a tocopherol (e.g. an α-tocopherol succinate). The emulsion may include these three components at a mass ratio of about 75:11:10 (e.g. 750 μg/ml polysorbate 80, 110 μg/ml Triton X-100 and 100 μg/ml α-tocopherol succinate), and these concentrations should include any contribution of these components from antigens. The emulsion may also include squalene. The emulsion may also include a 3d-MPL (see below). The aqueous phase may contain a phosphate buffer.

An emulsion of squalane, polysorbate 80 and poloxamer 401 ("Pluronic™ L121"). The emulsion can be formulated in phosphate buffered saline, pH 7.4. This emulsion is a useful delivery vehicle for muramyl dipeptides, and has been used with threonyl-MDP in the "SAF-1" adjuvant [42] (0.05-1% Thr-MDP, 5% squalane, 2.5% Pluronic L121 and 0.2% polysorbate 80). It can also be used without the Thr-MDP, as in the "AF" adjuvant [43] (5% squalane, 1.25% Pluronic L121 and 0.2% polysorbate 80). Microfluidisation is preferred.

An emulsion comprising squalene, an aqueous solvent, a polyoxyethylene alkyl ether hydrophilic nonionic surfactant (e.g. polyoxyethylene (12) cetostearyl ether) and a hydrophobic nonionic surfactant (e.g. a sorbitan ester or mannide ester, such as sorbitan monoleate or 'Span 80'). The emulsion is preferably thermoreversible and/or has at least 90% of the oil droplets (by volume) with a size less than 200 nm [44]. The emulsion may also include one or more of: alditol; a cryoprotective agent (e.g. a sugar, such as dodecylmaltoside and/or sucrose); and/or an alkylpolyglycoside. Such emulsions may be lyophilized.

An emulsion of squalene, poloxamer 105 and Abil-Care [45]. The final concentration (weight) of these components in adjuvanted vaccines are 5% squalene, 4% poloxamer 105 (pluronic polyol) and 2% Abil-Care 85 (Bis-PEG/PPG-16/16 PEG/PPG-16/16 dimethicone; caprylic/capric triglyceride).

An emulsion having from 0.5-50% of an oil, 0.1-10% of a phospholipid, and 0.05-5% of a non-ionic surfactant. As described in reference 46, preferred phospholipid components are phosphatidylcholine, phosphatidylethanolamine, phosphatidylserine, phosphatidylinositol, phosphatidylglycerol, phosphatidic acid, sphingomyelin and cardiolipin. Submicron droplet sizes are advantageous.

A submicron oil-in-water emulsion of a non-metabolisable oil (such as light mineral oil) and at least one surfactant (such as lecithin, Tween 80 or Span 80). Additives may be included, such as QuilA saponin, cholesterol, a saponin-lipophile conjugate (such as GPI-0100, described in reference 47, produced by addition of aliphatic amine to desacylsaponin via the carboxyl group of glucuronic acid), dimethyidioctadecylammonium bromide and/or N,N-dioctadecyl-N,N-bis (2-hydroxyethyl)propanediamine.

An emulsion in which a saponin (e.g. QuilA or QS21) and a sterol (e.g. a cholesterol) are associated as helical micelles [48].

An emulsion comprising a mineral oil, a non-ionic lipophilic ethoxylated fatty alcohol, and a non-ionic hydrophilic surfactant (e.g. an ethoxylated fatty alcohol and/or polyoxyethylene-polyoxypropylene block copolymer) [49].

An emulsion comprising a mineral oil, a non-ionic hydrophilic ethoxylated fatty alcohol, and a non-ionic lipophilic surfactant (e.g. an ethoxylated fatty alcohol and/or polyoxyethylene-polyoxypropylene block copolymer) [49].

In some embodiments an emulsion may be mixed with antigen extemporaneously, at the time of delivery, and thus the adjuvant and antigen may be kept separately in a packaged or distributed vaccine, ready for final formulation at the time of use. In other embodiments an emulsion is mixed with antigen during manufacture, and thus the composition is packaged in a liquid adjuvanted form. The antigen will generally be in an aqueous form, such that the vaccine is finally prepared by mixing two liquids. The volume ratio of the two liquids for mixing can vary (e.g. between 5:1 and 1:5) but is generally about 1:1. Where concentrations of components are given in the above descriptions of specific emulsions, these concentrations are typically for an undiluted composition, and the concentration after mixing with an antigen solution will thus decrease.

Where a composition includes a tocopherol, any of the $\alpha$, $\beta$, $\gamma$, $\delta$, $\epsilon$ or $\xi$ tocopherols can be used, but $\alpha$-tocopherols are preferred. The tocopherol can take several forms e.g. different salts and/or isomers. Salts include organic salts, such as succinate, acetate, nicotinate, etc. D-$\alpha$-tocopherol and DL-$\alpha$-tocopherol can both be used. Tocopherols are advantageously included in vaccines for use in elderly patients (e.g. aged 60 years or older) because vitamin E has been reported to have a positive effect on the immune response in this patient group [50]. They also have antioxidant properties that may help to stabilize the emulsions [51]. A preferred $\alpha$-tocopherol is DL-$\alpha$-tocopherol, and the preferred salt of this tocopherol is the succinate. The succinate salt has been found to cooperate with TNF-related ligands in vivo.

C. Saponin Formulations [Chapter 22 of Ref 32]

Saponin formulations may also be used as adjuvants in the invention. Saponins are a heterogeneous group of sterol glycosides and triterpenoid glycosides that are found in the bark, leaves, stems, roots and even flowers of a wide range of plant species. Saponin from the bark of the *Quillaia saponaria* Molina tree have been widely studied as adjuvants. Saponin can also be commercially obtained from *Smilax ornata* (sarsaprilla), *Gypsophilla paniculata* (brides veil), and *Saponaria officianalis* (soap root). Saponin adjuvant formulations include purified formulations, such as QS21, as well as lipid formulations, such as ISCOMs. QS21 is marketed as Stimulon™.

Saponin compositions have been purified using HPLC and RP-HPLC. Specific purified fractions using these techniques have been identified, including QS7, QS 17, QS 18, QS21, QH-A, QH-B and QH-C. Preferably, the saponin is QS21. A method of production of QS21 is disclosed in ref. 52. Saponin formulations may also comprise a sterol, such as cholesterol [53].

Combinations of saponins and cholesterols can be used to form unique particles called immunostimulating complexes (ISCOMs) [chapter 23 of ref. 32]. ISCOMs typically also include a phospholipid such as phosphatidylethanolamine or phosphatidylcholine. Any known saponin can be used in ISCOMs. Preferably, the ISCOM includes one or more of QuilA, QHA & QHC. ISCOMs are further described in refs. 53-55. Optionally, the ISCOMS may be devoid of additional detergent [56].

A review of the development of saponin based adjuvants can be found in refs. 57 & 58.

D. Virosomes and Virus Like Particles

Virosomes and virus-like particles (VLPs) can also be used as adjuvants in the invention. These structures generally contain one or more proteins from a virus optionally combined or formulated with a phospholipid. They are generally non-pathogenic, non-replicating and generally do not contain any of the native viral genome. The viral proteins may be recombinantly produced or isolated from whole viruses. These viral proteins suitable for use in virosomes or VLPs include proteins derived from influenza virus (such as HA or NA), Hepatitis B virus (such as core or capsid proteins), Hepatitis E virus, measles virus, Sindbis virus, Rotavirus, Foot-and-Mouth Disease virus, Retrovirus, Norwalk virus, human Papilloma virus, HIV, RNA-phages, Qβ-phage (such as coat proteins), GA-phage, fr-phage, AP205 phage, and Ty (such as retrotransposon Ty protein p1). VLPs are discussed further in refs. 59-64. Virosomes are discussed further in, for example, ref. 65

E. Bacterial or Microbial Derivatives

Adjuvants suitable for use in the invention include bacterial or microbial derivatives such as non-toxic derivatives of enterobacterial lipopolysaccharide (LPS), Lipid A derivatives, immunostimulatory oligonucleotides and ADP-ribosylating toxins and detoxified derivatives thereof.

Non-toxic derivatives of LPS include monophosphoryl lipid A (MPL) and 3-O-deacylated MPL (3dMPL). 3dMPL is a mixture of 3 de-O-acylated monophosphoryl lipid A with 4, 5 or 6 acylated chains A preferred "small particle" form of 3 De-O-acylated monophosphoryl lipid A is disclosed in ref. 66. Such "small particles" of 3dMPL are small enough to be sterile filtered through a 0.22 µm membrane [66]. Other non-toxic LPS derivatives include monophosphoryl lipid A mimics, such as aminoalkyl glucosaminide phosphate derivatives e.g. RC-529 [67,68].

Lipid A derivatives include derivatives of lipid A from *Escherichia coli* such as OM-174. OM-174 is described for example in refs. 69 & 70.

Immunostimulatory oligonucleotides suitable for use as adjuvants in the invention include nucleotide sequences containing a CpG motif (a dinucleotide sequence containing an unmethylated cytosine linked by a phosphate bond to a guanosine). Double-stranded RNAs and oligonucleotides containing palindromic or poly(dG) sequences have also been shown to be immunostimulatory.

The CpG's can include nucleotide modifications/analogs such as phosphorothioate modifications and can be double-stranded or single-stranded. References 71, 72 and 73 disclose possible analog substitutions e.g. replacement of guanosine with 2'-deoxy-7-deazaguanosine. The adjuvant effect of CpG oligonucleotides is further discussed in refs. 74-79.

The CpG sequence may be directed to TLR9, such as the motif GTCGTT or TTCGTT [80]. The CpG sequence may be specific for inducing a Th1 immune response, such as a CpG-A ODN, or it may be more specific for inducing a B cell response, such a CpG-B ODN. CpG-A and CpG-B ODNs are discussed in refs. 81-83. Preferably, the CpG is a CpG-A ODN.

Preferably, the CpG oligonucleotide is constructed so that the 5' end is accessible for receptor recognition. Optionally, two CpG oligonucleotide sequences may be attached at their 3' ends to form "immunomers". See, for example, refs. 80 & 84-86.

A useful CpG adjuvant is CpG7909, also known as Pro-Mune™ (Coley Pharmaceutical Group, Inc.). Another is CpG 1826. As an alternative, or in addition, to using CpG sequences, TpG sequences can be used [87], and these oligonucleotides may be free from unmethylated CpG motifs. The immunostimulatory oligonucleotide may be pyrimidine-rich. For example, it may comprise more than one consecutive thymidine nucleotide (e.g. TTTT, as disclosed in ref. 87), and/or it may have a nucleotide composition with >25% thymidine (e.g. >35%, >40%, >50%, >60%, >80%, etc.). For example, it may comprise more than one consecutive cytosine nucleotide (e.g. CCCC, as disclosed in ref. 87), and/or it may have a nucleotide composition with >25% cytosine (e.g. >35%, >40%, >50%, >60%, >80%, etc.). These oligonucleotides may be free from unmethylated CpG motifs. Immunostimulatory oligonucleotides will typically comprise at least 20 nucleotides. They may comprise fewer than 100 nucleotides.

A particularly useful adjuvant based around immunostimulatory oligonucleotides is known as IC-31™ [88]. Thus an adjuvant used with the invention may comprise a mixture of (i) an oligonucleotide (e.g. between 15-40 nucleotides) including at least one (and preferably multiple) CpI motifs (i.e. a cytosine linked to an inosine to form a dinucleotide), and (ii) a polycationic polymer, such as an oligopeptide (e.g. between 5-20 amino acids) including at least one (and preferably multiple) Lys-Arg-Lys tripeptide sequence(s). The oligonucleotide may be a deoxynucleotide comprising 26-mer sequence 5'-(IC)$_{13}$-3' (SEQ ID NO: 96). The polycationic polymer may be a peptide comprising 11-mer amino acid sequence KLKLLLLLKLK (SEQ ID NO: 97).

Bacterial ADP-ribosylating toxins and detoxified derivatives thereof may be used as adjuvants in the invention. Preferably, the protein is derived from *E. coli* (*E. coli* heat labile enterotoxin "LT"), cholera ("CT"), or pertussis ("PT"). The use of detoxified ADP-ribosylating toxins as mucosal adjuvants is described in ref. 89 and as parenteral adjuvants in ref. 90. The toxin or toxoid is preferably in the form of a holotoxin, comprising both A and B subunits. Preferably, the A subunit contains a detoxifying mutation; preferably the B subunit is not mutated. Preferably, the adjuvant is a detoxified LT mutant such as LT-K63, LT-R72, and LT-G192. The use of ADP-ribosylating toxins and detoxified derivatives thereof, particularly LT-K63 and LT-R72, as adjuvants can be found in refs. 91-98. A useful CT mutant is or CT-E29H [99]. Numerical reference for amino acid substitutions is preferably based on the alignments of the A and B subunits of ADP-ribosylating toxins set forth in ref 100, specifically incorporated herein by reference in its entirety solely for the purpose of the alignment and amino acid numbering therein.

F. Human Immunomodulators

Human immunomodulators suitable for use as adjuvants in the invention include cytokines, such as interleukins (e.g. IL-1, IL-2, IL-4, IL-5, IL-6, IL-7, IL-12 [101], etc.) [102], interferons (e.g. interferon-γ), macrophage colony stimulating factor, and tumor necrosis factor. A preferred immunomodulator is IL-12.

G. Bioadhesives and Mucoadhesives

Bioadhesives and mucoadhesives may also be used as adjuvants in the invention. Suitable bioadhesives include esterified hyaluronic acid microspheres [103] or mucoadhesives such as cross-linked derivatives of poly(acrylic acid), polyvinyl alcohol, polyvinyl pyrollidone, polysaccharides and carboxymethylcellulose. Chitosan and derivatives thereof may also be used as adjuvants in the invention [104].

H. Microparticles

Microparticles may also be used as adjuvants in the invention. Microparticles (i.e. a particle of ~100 nm to ~150 µm in diameter, more preferably ~200 nm to ~30 µm in diameter, and most preferably ~500 nm to ~10 µm in diameter) formed from materials that are biodegradable and non-toxic (e.g. a poly(α-hydroxy acid), a polyhydroxybutyric acid, a polyorthoester, a polyanhydride, a polycaprolactone, etc.), with poly(lactide-co-glycolide) are preferred, optionally treated to have a negatively-charged surface (e.g. with SDS) or a positively-charged surface (e.g. with a cationic detergent, such as CTAB).

I. Liposomes (Chapters 13 & 14 of ref 32)

Examples of liposome formulations suitable for use as adjuvants are described in refs. 105-107.

J. Polyoxyethylene Ether and Polyoxyethylene Ester Formulations

Adjuvants suitable for use in the invention include polyoxyethylene ethers and polyoxyethylene esters [108]. Such formulations further include polyoxyethylene sorbitan ester surfactants in combination with an octoxynol [109] as well as polyoxyethylene alkyl ethers or ester surfactants in combination with at least one additional non-ionic surfactant such as an octoxynol [110]. Preferred polyoxyethylene ethers are selected from the following group: polyoxyethylene-9-lauryl ether (laureth 9), polyoxyethylene-9-steoryl ether, polyoxytheylene-8-steoryl ether, polyoxyethylene-4-lauryl ether, polyoxyethylene-35-lauryl ether, and polyoxyethylene-23-lauryl ether.

K. Phosphazenes

A phosphazene, such as poly[di(carboxylatophenoxy)phosphazene] ("PCPP") as described, for example, in references 111 and 112, may be used.

L. Muramyl Peptides

Examples of muramyl peptides suitable for use as adjuvants in the invention include N-acetyl-muramyl-L-threonyl-D-isoglutamine (thr-MDP), N-acetyl-normuramyl-L-alanyl-D-isoglutamine (nor-MDP), and N-acetylmuramyl-L-alanyl-D-isoglutaminyl-L-alanine-2-(1'-2'-dipalmitoyl-sn-glycero-3-hydroxyphosphoryloxy)-ethylamine MTP-PE).

M. Imidazoquinolone Compounds

Examples of imidazoquinolone compounds suitable for use adjuvants in the invention include Imiquimod ("R-837") [113,114], Resiquimod ("R-848") [115], and their analogs; and salts thereof (e.g. the hydrochloride salts). Further details about immunostimulatory imidazoquinolines can be found in references 116 to 120.

N. Substituted Ureas

Substituted ureas useful as adjuvants include compounds of formula I, II or III, or salts thereof:

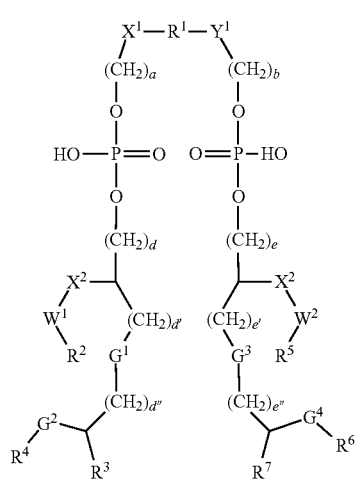

I

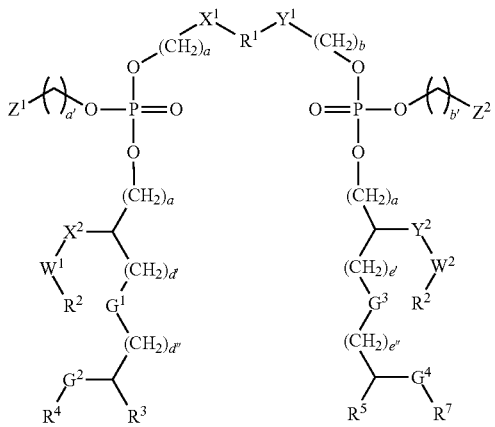

II

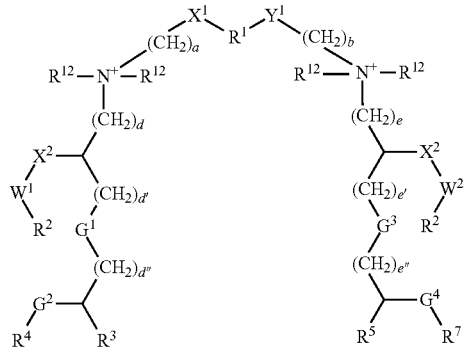

III as defined in reference 121, such as 'ER 803058', 'ER 803732', 'ER 804053', ER 804058', 'ER 804059', 'ER 804442', 'ER 804680', 'ER 804764', ER 803022 or 'ER 804057' e.g.:

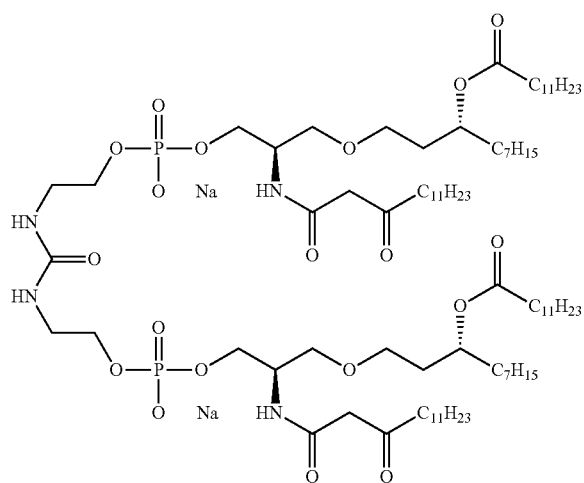

ER804057

ER-803022:

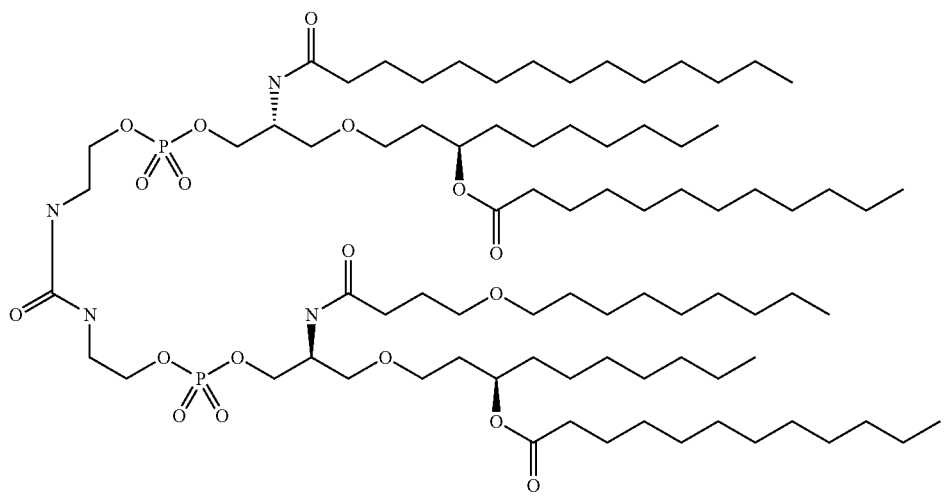

O. Further Adjuvants

Further adjuvants that may be used with the invention include:

- An aminoalkyl glucosaminide phosphate derivative, such as RC-529 [122,123].
- A thiosemicarbazone compound, such as those disclosed in reference 124. Methods of formulating, manufacturing, and screening for active compounds are also described in reference 124. The thiosemicarbazones are particularly effective in the stimulation of human peripheral blood mononuclear cells for the production of cytokines, such as TNF-α.
- A tryptanthrin compound, such as those disclosed in reference 125. Methods of formulating, manufacturing, and screening for active compounds are also described in reference 125. The thiosemicarbazones are particularly effective in the stimulation of human peripheral blood mononuclear cells for the production of cytokines, such as TNF-α.
- A nucleoside analog, such as: (a) Isatorabine (ANA-245; 7-thia-8-oxoguanosine):

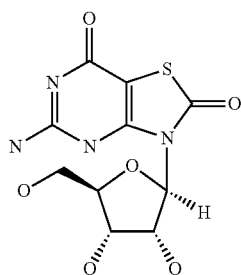 [SMILES: Nc1nc(=O)c2sc(=O)n([C@@H]3O[C@H](CO)[C@@H](O)[C@H]3O)c2[nH]1]

and prodrugs thereof; (b) ANA975; (c) ANA-025-1; (d) ANA380; (e) the compounds disclosed in references 126 to 128Loxoribine (7-allyl-8-oxoguanosine) [129].
- Compounds disclosed in reference 130, including: Acylpiperazine compounds, Indoledione compounds, Tetrahydraisoquinoline (THIQ) compounds, Benzocyclodione compounds, Aminoazavinyl compounds, Aminobenzimidazole quinolinone (ABIQ) compounds [131,132], Hydrapthalamide compounds, Benzophenone compounds, Isoxazole compounds, Sterol compounds, Quinazilinone compounds, Pyrrole compounds [133], Anthraquinone compounds, Quinoxaline compounds, Triazine compounds, Pyrazalopyrimidine compounds, and Benzazole compounds [134].
- Compounds containing lipids linked to a phosphate-containing acyclic backbone, such as the TLR4 antagonist E5564 [135,136]:
- A polyoxidonium polymer [137,138] or other N-oxidized polyethylene-piperazine derivative.
- Methyl inosine 5'-monophosphate ("MIMP") [139].
- A polyhydroxlated pyrrolizidine compound [140], such as one having formula:

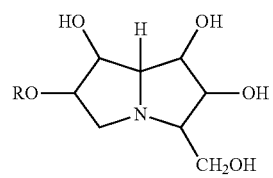

where R is selected from the group comprising hydrogen, straight or branched, unsubstituted or substituted, saturated or unsaturated acyl, alkyl (e.g. cycloalkyl), alkenyl, alkynyl and aryl groups, or a pharmaceutically acceptable salt or derivative thereof. Examples include, but are not limited to: casuarine, casuarine-6-α-D-glucopyranose, 3-epi-casuarine, 7-epi-casuarine, 3,7-diepi-casuarine, etc.
- A CD1d ligand, such as an α-glycosylceramide [141-148] (e.g. α-galactosylceramide), phytosphingosine-containing α-glycosylceramides, OCH, KRN7000 [(2S,3S,4R)-1-O-(α-D-galactopyranosyl)-2-(N-hexacosanoylamino)-1,3,4-octadecanetriol], CRONY-101, 3"-O-sulfo-galactosylceramide, etc.
- A gamma inulin [149] or derivative thereof, such as algammulin.

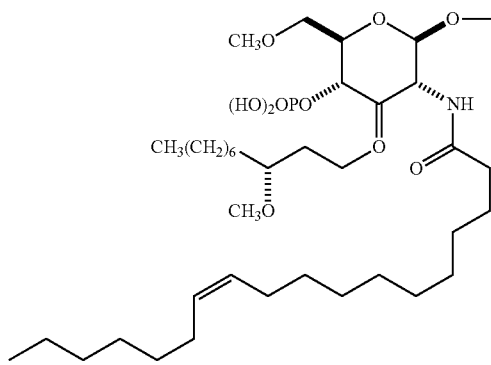
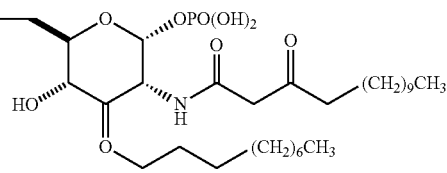

Adjuvant Combinations

The invention may also comprise combinations of aspects of one or more of the adjuvants identified above. For example, the following adjuvant compositions may be used in the invention: (1) a saponin and an oil-in-water emulsion [150]; (2) a saponin (e.g. QS21)+a non-toxic LPS derivative (e.g. 3dMPL) [151]; (3) a saponin (e.g. QS21)+a non-toxic LPS derivative (e.g. 3dMPL)+a cholesterol; (4) a saponin (e.g. QS21)+3dMPL+IL-12 (optionally+a sterol) [152]; (5) combinations of 3dMPL with, for example, QS21 and/or oil-in-water emulsions [153]; (6) SAF, containing 10% squalane, 0.4% Tween 80™, 5% pluronic-block polymer L121, and thr-MDP, either microfluidized into a submicron emulsion or vortexed to generate a larger particle size emulsion. (7) Ribi™ adjuvant system (RAS), (Ribi Immunochem) containing 2% squalene, 0.2% Tween 80, and one or more bacterial cell wall components from the group consisting of monophosphorylipid A (MPL), trehalose dimycolate (TDM), and cell wall skeleton (CWS), preferably MPL+CWS (Detox™); and (8) one or more mineral salts (such as an aluminum salt)+a non-toxic derivative of LPS (such as 3dMPL).

Other substances that act as immunostimulating agents are disclosed in chapter 7 of ref. 32.

The use of an aluminium hydroxide and/or aluminium phosphate adjuvant is particularly preferred, and antigens are generally adsorbed to these salts. Calcium phosphate is another preferred adjuvant. Other preferred adjuvant combinations include combinations of Th1 and Th2 adjuvants such as CpG & alum or resiquimod & alum. A combination of aluminium phosphate and 3dMPL may be used.

The compositions of the invention may elicit both a cell mediated immune response as well as a humoral immune response. This immune response will preferably induce long lasting (e.g. neutralising) antibodies and a cell mediated immunity that can quickly respond upon exposure to pnuemococcus.

Two types of T cells, CD4 and CD8 cells, are generally thought necessary to initiate and/or enhance cell mediated immunity and humoral immunity. CD8 T cells can express a CD8 co-receptor and are commonly referred to as Cytotoxic T lymphocytes (CTLs). CD8 T cells are able to recognized or interact with antigens displayed on MHC Class I molecules.

CD4 T cells can express a CD4 co-receptor and are commonly referred to as T helper cells. CD4 T cells are able to recognize antigenic peptides bound to MHC class II molecules. Upon interaction with a MHC class II molecule, the CD4 cells can secrete factors such as cytokines. These secreted cytokines can activate B cells, cytotoxic T cells, macrophages, and other cells that participate in an immune response. Helper T cells or CD4+ cells can be further divided into two functionally distinct subsets: TH1 phenotype and TH2 phenotypes which differ in their cytokine and effector function.

Activated TH1 cells enhance cellular immunity (including an increase in antigen-specific CTL production) and are therefore of particular value in responding to intracellular infections. Activated TH1 cells may secrete one or more of IL-2, IFN-γ, and TNF-β. A TH1 immune response may result in local inflammatory reactions by activating macrophages, NK (natural killer) cells, and CD8 cytotoxic T cells (CTLs). A TH1 immune response may also act to expand the immune response by stimulating growth of B and T cells with IL-12. TH1 stimulated B cells may secrete IgG2a.

Activated TH2 cells enhance antibody production and are therefore of value in responding to extracellular infections. Activated TH2 cells may secrete one or more of IL-4, IL-5, IL-6, and IL-10. A TH2 immune response may result in the production of IgG1, IgE, IgA and memory B cells for future protection.

An enhanced immune response may include one or more of an enhanced TH1 immune response and a TH2 immune response.

A TH1 immune response may include one or more of an increase in CTLs, an increase in one or more of the cytokines associated with a TH1 immune response (such as IL-2, IFN-γ, and TNF-β), an increase in activated macrophages, an increase in NK activity, or an increase in the production of IgG2a. Preferably, the enhanced TH1 immune response will include an increase in IgG2a production.

A TH1 immune response may be elicited using a TH1 adjuvant. A TH1 adjuvant will generally elicit increased levels of IgG2a production relative to immunization of the antigen without adjuvant. TH1 adjuvants suitable for use in the invention may include for example saponin formulations, virosomes and virus like particles, non-toxic derivatives of enterobacterial lipopolysaccharide (LPS), immunostimulatory oligonucleotides. Immunostimulatory oligonucleotides, such as oligonucleotides containing a CpG motif, are preferred TH1 adjuvants for use in the invention.

A TH2 immune response may include one or more of an increase in one or more of the cytokines associated with a TH2 immune response (such as IL-4, IL-5, IL-6 and IL-10), or an increase in the production of IgG1, IgE, IgA and memory B cells. Preferably, the enhanced TH2 immune resonse will include an increase in IgG 1 production.

A TH2 immune response may be elicited using a TH2 adjuvant. A TH2 adjuvant will generally elicit increased levels of IgG1 production relative to immunization of the antigen without adjuvant. TH2 adjuvants suitable for use in the invention include, for example, mineral containing compositions, oil-emulsions, and ADP-ribosylating toxins and detoxified derivatives thereof. Mineral containing compositions, such as aluminium salts are preferred TH2 adjuvants for use in the invention.

Preferably, the invention includes a composition comprising a combination of a TH1 adjuvant and a TH2 adjuvant. Preferably, such a composition elicits an enhanced TH1 and an enhanced TH2 response, i.e., an increase in the production of both IgG1 and IgG2a production relative to immunization without an adjuvant. Still more preferably, the composition comprising a combination of a TH1 and a TH2 adjuvant elicits an increased TH1 and/or an increased TH2 immune response relative to immunization with a single adjuvant (i.e., relative to immunization with a TH1 adjuvant alone or immunization with a TH2 adjuvant alone).

The immune response may be one or both of a TH1 immune response and a TH2 response. Preferably, immune response provides for one or both of an enhanced TH1 response and an enhanced TH2 response.

The enhanced immune response may be one or both of a systemic and a mucosal immune response. Preferably, the immune response provides for one or both of an enhanced systemic and an enhanced mucosal immune response. Preferably the mucosal immune response is a TH2 immune response. Preferably, the mucosal immune response includes an increase in the production of IgA.

E. coli can cause disease at a number of anatomical locations [4] and so the compositions of the invention may be prepared in various forms. For example, the compositions may be prepared as injectables, either as liquid solutions or suspensions. Solid forms suitable for solution in, or suspension in, liquid vehicles prior to injection can also be prepared (e.g. a lyophilised composition or a spray-freeze dried composition). The composition may be prepared for topical administration e.g. as an ointment, cream or powder. The composition may be prepared for oral administration e.g. as a tablet or capsule, as a spray, or as a syrup (optionally flavoured). The composition may be prepared for pulmonary administration e.g. as an inhaler, using a fine powder or a spray. The composition may be prepared as a suppository or pessary. The composition may be prepared for nasal, aural or ocular administration e.g. as drops. The composition may be in kit form, designed such that a combined composition is reconstituted just prior to administration to a patient. Such kits may comprise one or more antigens in liquid form and one or more lyophilised antigens.

Where a composition is to be prepared extemporaneously prior to use (e.g. where a component is presented in lyophilised form) and is presented as a kit, the kit may comprise two vials, or it may comprise one ready-filled syringe and one vial, with the contents of the syringe being used to reactivate the contents of the vial prior to injection.

Immunogenic compositions used as vaccines comprise an immunologically effective amount of antigen(s), as well as any other components, as needed. By 'immunologically effective amount', it is meant that the administration of that amount to an individual, either in a single dose or as part of a series, is effective for treatment or prevention. This amount varies depending upon the health and physical condition of the individual to be treated, age, the taxonomic group of individual to be treated (e.g. non-human primate, primate, etc.), the capacity of the individual's immune system to synthesise antibodies, the degree of protection desired, the formulation of the vaccine, the treating doctor's assessment of the medical situation, and other relevant factors. It is expected that the amount will fall in a relatively broad range that can be determined through routine trials.

Methods of Treatment, and Administration of the Vaccine

The invention also provides a method for raising an immune response in a mammal comprising the step of administering an effective amount of a composition of the invention. The immune response is preferably protective and preferably involves antibodies and/or cell-mediated immunity. The method may raise a booster response.

The invention also provides a polypeptide of the invention for use as a medicament e.g. for use in raising an immune response in a mammal.

The invention also provides the use of a polypeptide of the invention in the manufacture of a medicament for raising an immune response in a mammal.

The invention also provides a delivery device pre-filled with an immunogenic composition of the invention.

By raising an immune response in the mammal by these uses and methods, the mammal can be protected against E. coli infection, including ExPEC and non-ExPEC strains. The invention is particularly useful for providing broad protection against pathogenic E. coli, including intestinal pathotypes such as EPEC, EAEC, EIEC, ETEC and DAEC pathotypes. Thus the mammal may be protected against diseases including, but not limited to peritonitis, pyelonephritis, cystitis, endocarditis, prostatitis, urinary tract infections (UTIs), meningitis (particularly neonatal meningitis), sepsis (or SIRS), dehydration, pneumonia, diarrhea (infantile, travellers', acute, persistent, etc.), bacillary dysentery, hemolytic uremic syndrome (HUS), pericarditis, bacteriuria, etc.

SEQ ID NO: 3 and 12 and their variants are particularly useful for immunising against the EAEC pathotype, and thus for preventing diarrhea (both acute and chronic).

SEQ ID NO: 3, 12, 199, 109, 115, and 124 and their variants are particularly useful for immunising against the EAEC pathotype, and thus for preventing diarrhea (both acute and chronic).

SEQ ID NO: 3, 12, 199, 109, 115, 124, 129, 130, and 131 and their variants are particularly useful for immunising against the EAEC pathotype, and thus for preventing diarrhea (both acute and chronic).

SEQ ID NO: 4 and 10 and their variants are particularly useful for immunising against the UPEC pathotype, and thus for preventing UTIs including, but not limited to, pyelonephritis, cystitis (both acute and recurrent), peritonitis, catheter-associated UTIs, prostatisis, and bacteriuria (including asymptomatic bacteriuria).

SEQ ID NO: 4, 10, 101, 107, 116, and 126 and their variants are particularly useful for immunising against the UPEC pathotype, and thus for preventing UTIs including, but not limited to, pyelonephritis, cystitis (both acute and recurrent), peritonitis, catheter-associated UTIs, prostatisis, and bacteriuria (including asymptomatic bacteriuria).

SEQ ID NO: 4, 10, 101, 107, 116, 126, 133, 134, 135, 137, 138, and 139 and their variants are particularly useful for immunising against the UPEC pathotype, and thus for preventing UTIs including, but not limited to, pyelonephritis, cystitis (both acute and recurrent), peritonitis, catheter-associated UTIs, prostatisis, and bacteriuria (including asymptomatic bacteriuria).

SEQ ID NO: 5 and its variants are particularly useful for immunising against the EIEC pathotype, and thus for preventing dysentery (in particular bacillary dysentery) and HUS (e.g. in children).

SEQ ID NO: 5, 102, and 117 and their variants are particularly useful for immunising against the EIEC pathotype, and thus for preventing dysentery (in particular bacillary dysentery) and HUS (e.g. in children).

SEQ ID NO: 6, 9, and 11 and their variants are particularly useful for immunising against the ETEC pathotype, and thus for preventing diarrhea (including travellers' and infant diarrhea).

SEQ ID NO: 6, 9, 11, 103, 106, 108, 118, 121, and 123 and their variants are also particularly useful for immunising against the ETEC pathotype, and thus for preventing diarrhea (including travellers' and infant diarrhea).

SEQ ID NOs: 7, 8, and 16 and their variants are particularly useful for immunising against the EPEC pathotype, and thus for preventing diarrhea (including infantile diarrhea).

SEQ ID NOs: 7, 8, 16, 104, 105, 113, 119, 120, and 128 and their variants are also particularly useful for immunising against the EPEC pathotype, and thus for preventing diarrhea (including infantile diarrhea).

The mammal is preferably a human, but may be e.g. a cow, a pig, a chicken, a cat or a dog, as *E. coli* disease is also problematic in these species [4]. Where the vaccine is for prophylactic use, the human is preferably a child (e.g. a toddler or infant) or a teenager; where the vaccine is for therapeutic use, the human is preferably a teenager or an adult. A vaccine intended for children may also be administered to adults e.g. to assess safety, dosage, immunogenicity, etc.

One way of checking efficacy of therapeutic treatment involves monitoring *E. coli* infection after administration of the compositions of the invention. One way of checking efficacy of prophylactic treatment involves monitoring immune responses, systemically (such as monitoring the level of IgG1 and IgG2a production) and/or mucosally (such as monitoring the level of IgA production), against the antigens in the compositions of the invention after administration of the composition. Typically, antigen-specific serum antibody responses are determined post-immunisation but pre-challenge whereas antigen-specific mucosal antibody responses are determined post-immunisation and post-challenge.

Another way of assessing the immunogenicity of the compositions of the present invention is to express the proteins recombinantly for screening patient sera or mucosal secretions by immunoblot and/or microarrays. A positive reaction between the protein and the patient sample indicates that the patient has mounted an immune response to the protein in question. This method may also be used to identify immunodominant antigens and/or epitopes within antigens.

The efficacy of vaccine compositions can also be determined in vivo by challenging animal models of *E. coli* infection, e.g., guinea pigs or mice, with the vaccine compositions. A murine model of ExPEC and lethal sepsis is described in reference 154. A cotton rat model is disclosed in ref. 155

Compositions of the invention will generally be administered directly to a patient. Direct delivery may be accomplished by parenteral injection (e.g. subcutaneously, intraperitoneally, intravenously, intramuscularly, or to the interstitial space of a tissue), or mucosally, such as by rectal, oral (e.g. tablet, spray), vaginal, topical, transdermal or transcutaneous, intranasal, ocular, aural, pulmonary or other mucosal administration.

The invention may be used to elicit systemic and/or mucosal immunity, preferably to elicit an enhanced systemic and/or mucosal immunity.

Preferably the enhanced systemic and/or mucosal immunity is reflected in an enhanced TH 1 and/or TH2 immune response. Preferably, the enhanced immune response includes an increase in the production of IgG 1 and/or IgG2a and/or IgA.

Dosage can be by a single dose schedule or a multiple dose schedule. Multiple doses may be used in a primary immunisation schedule and/or in a booster immunisation schedule. In a multiple dose schedule the various doses may be given by the same or different routes e.g. a parenteral prime and mucosal boost, a mucosal prime and parenteral boost, etc. Multiple doses will typically be administered at least 1 week apart (e.g. about 2 weeks, about 3 weeks, about 4 weeks, about 6 weeks, about 8 weeks, about 10 weeks, about 12 weeks, about 16 weeks, etc.).

Vaccines of the invention may be used to treat both children and adults. Thus a human patient may be less than 1 year old, 1-5 years old, 5-15 years old, 15-55 years old, or at least 55 years old. Preferred patients for receiving the vaccines are the elderly (e.g. $\geq 50$ years old, $\geq 60$ years old, and preferably $\geq 65$ years), the young (e.g. $\leq 5$ years old), hospitalised patients, healthcare workers, armed service and military personnel, pregnant women, the chronically ill, or immunodeficient patients. The vaccines are not suitable solely for these groups, however, and may be used more generally in a population.

Vaccines of the invention are particularly useful for patients who are expecting a surgical operation, or other hospital in-patients. They are also useful in patients who will be catheterized. They are also useful in adolescent females (e.g. aged 11-18) and in patients with chronic urinary tract infections.

Vaccines of the invention may be administered to patients at substantially the same time as (e.g. during the same medical consultation or visit to a healthcare professional or vaccination centre) other vaccines e.g. at substantially the same time as a measles vaccine, a mumps vaccine, a rubella vaccine, a MMR vaccine, a varicella vaccine, a MMRV vaccine, a diphtheria vaccine, a tetanus vaccine, a pertussis vaccine, a DTP vaccine, a conjugated *H. influenzae* type b vaccine, an inactivated poliovirus vaccine, a hepatitis B virus vaccine, a meningococcal conjugate vaccine (such as a tetravalent A-C-W135-Y vaccine), a respiratory syncytial virus vaccine, etc.

Nucleic Acid Immunisation

The immunogenic compositions described above include polypeptide antigens. In all cases, however, the polypeptide antigens can be replaced by nucleic acids (typically DNA) encoding those polypeptides, to give compositions, methods and uses based on nucleic acid immunisation. Nucleic acid immunisation is now a developed field (e.g. see references 156 to 163 etc.).

The nucleic acid encoding the immunogen is expressed in vivo after delivery to a patient and the expressed immunogen then stimulates the immune system. The active ingredient will typically take the form of a nucleic acid vector comprising: (i) a promoter; (ii) a sequence encoding the immunogen, operably linked to the promoter; and optionally (iii) a selectable marker. Preferred vectors may further comprise (iv) an origin of replication; and (v) a transcription terminator downstream of and operably linked to (ii). In general, (i) & (v) will be eukaryotic and (iii) & (iv) will be prokaryotic.

Preferred promoters are viral promoters e.g. from cytomegalovirus (CMV). The vector may also include transcriptional regulatory sequences (e.g. enhancers) in addition to the promoter and which interact functionally with the promoter. Preferred vectors include the immediate-early CMV enhancer/promoter, and more preferred vectors also include CMV intron A. The promoter is operably linked to a downstream sequence encoding an immunogen, such that expression of the immunogen-encoding sequence is under the promoter's control.

Where a marker is used, it preferably functions in a microbial host (e.g. in a prokaryote, in a bacteria, in a yeast). The marker is preferably a prokaryotic selectable marker (e.g.

transcribed under the control of a prokaryotic promoter). For convenience, typical markers are antibiotic resistance genes.

The vector of the invention is preferably an autonomously replicating episomal or extrachromosomal vector, such as a plasmid.

The vector of the invention preferably comprises an origin of replication. It is preferred that the origin of replication is active in prokaryotes but not in eukaryotes.

Preferred vectors thus include a prokaryotic marker for selection of the vector, a prokaryotic origin of replication, but a eukaryotic promoter for driving transcription of the immunogen-encoding sequence. The vectors will therefore (a) be amplified and selected in prokaryotic hosts without polypeptide expression, but (b) be expressed in eukaryotic hosts without being amplified. This arrangement is ideal for nucleic acid immunization vectors.

The vector of the invention may comprise a eukaryotic transcriptional terminator sequence downstream of the coding sequence. This can enhance transcription levels. Where the coding sequence does not have its own, the vector of the invention preferably comprises a polyadenylation sequence. A preferred polyadenylation sequence is from bovine growth hormone.

The vector of the invention may comprise a multiple cloning site

In addition to sequences encoding the immunogen and a marker, the vector may comprise a second eukaryotic coding sequence. The vector may also comprise an IRES upstream of said second sequence in order to permit translation of a second eukaryotic polypeptide from the same transcript as the immunogen. Alternatively, the immunogen-coding sequence may be downstream of an IRES.

The vector of the invention may comprise unmethylated CpG motifs e.g. unmethylated DNA sequences which have in common a cytosine preceding a guanosine, flanked by two 5' purines and two 3' pyrimidines. In their unmethylated form these DNA motifs have been demonstrated to be potent stimulators of several types of immune cell.

Vectors may be delivered in a targeted way. Receptor-mediated DNA delivery techniques are described in, for example, references 164 to 169. Therapeutic compositions containing a nucleic acid are administered in a range of about 100 ng to about 200 mg of DNA for local administration in a gene therapy protocol. Concentration ranges of about 500 ng to about 50 mg, about 1 µg to about 2 mg, about 5 µg to about 500 µg, and about 20 µg to about 100 µg of DNA can also be used during a gene therapy protocol. Factors such as method of action (e.g. for enhancing or inhibiting levels of the encoded gene product) and efficacy of transformation and expression are considerations which will affect the dosage required for ultimate efficacy. Where greater expression is desired over a larger area of tissue, larger amounts of vector or the same amounts re-administered in a successive protocol of administrations, or several administrations to different adjacent or close tissue portions may be required to effect a positive therapeutic outcome. In all cases, routine experimentation in clinical trials will determine specific ranges for optimal therapeutic effect.

Vectors can be delivered using gene delivery vehicles. The gene delivery vehicle can be of viral or non-viral origin (see generally references 170 to 173).

Viral-based vectors for delivery of a desired nucleic acid and expression in a desired cell are well known in the art. Exemplary viral-based vehicles include, but are not limited to, recombinant retroviruses (e.g. references 174 to 184), alphavirus-based vectors (e.g. Sindbis virus vectors, Semliki forest virus (ATCC VR-67; ATCC VR-1247), Ross River virus (ATCC VR-373; ATCC VR-1246) and Venezuelan equine encephalitis virus (ATCC VR-923; ATCC VR-1250; ATCC VR 1249; ATCC VR-532); hybrids or chimeras of these viruses may also be used), poxvirus vectors (e.g. vaccinia, fowlpox, canarypox, modified vaccinia Ankara, etc.), adenovirus vectors, and adeno-associated virus (AAV) vectors (e.g. see refs. 185 to 190). Administration of DNA linked to killed adenovirus [191] can also be employed.

Non-viral delivery vehicles and methods can also be employed, including, but not limited to, polycationic condensed DNA linked or unlinked to killed adenovirus alone [e.g. 191], ligand-linked DNA [192], eukaryotic cell delivery vehicles cells [e.g. refs. 193 to 197] and nucleic charge neutralization or fusion with cell membranes. Naked DNA can also be employed. Exemplary naked DNA introduction methods are described in refs. 198 and 199. Liposomes (e g. immunoliposomes) that can act as gene delivery vehicles are described in refs. 200 to 204. Additional approaches are described in references 205 & 206.

Further non-viral delivery suitable for use includes mechanical delivery systems such as the approach described in ref. 206. Moreover, the coding sequence and the product of expression of such can be delivered through deposition of photopolymerized hydrogel materials or use of ionizing radiation [e.g. refs. 207 & 208]. Other conventional methods for gene delivery that can be used for delivery of the coding sequence include, for example, use of hand-held gene transfer particle gun [209] or use of ionizing radiation for activating transferred genes [207 & 208].

Delivery DNA using PLG {poly(lactide-co-glycolide)} microparticles is a particularly preferred method e.g. by adsorption to the microparticles, which are optionally treated to have a negatively-charged surface (e.g. treated with SDS) or a positively-charged surface (e.g. treated with a cationic detergent, such as CTAB).

Reference 5 and Disclaimers

In some embodiments, the invention may not encompass the use of a polypeptide encoded by SEQ ID NO: 1 e.g. it does not encompass the use of a polypeptide comprising amino acid sequence SEQ ID NO: 2, or it does not encompass the use of a polypeptide having N-terminal sequence SEQ ID NO: 98. Such polypeptides, and their coding sequences, are disclosed in reference 5 for use in immunising against NMEC infections.

In other embodiments, however, the polypeptides of reference 5 are encompassed, but e.g. for new medical purposes. As disclosed herein, the close homology between different *E. coli* pathotypes means that an immune response against a NMEC-derived polypeptide may provide cross-protection against non-NMEC strains. Thus, when the invention relates to the treatment or prophylaxis of diseases caused by *E. coli* strains that are not in the NMEC pathotype (e.g. against APEC, UPEC or SEPEC strains of ExPEC; or against intestinal *E. coli* pathotypes, such as EPEC, EAEC, EIEC, ETEC or DAEC strains) then the polypeptides of reference 5 may be encompassed.

Antibodies

Antibodies against *E. coli* antigens can be used for passive immunisation [210]. Thus the invention provides an antibody that binds to at least 2 (e.g. to 3, 4, 5, 6, 7, 8, 9, 10, 11, 12 or all 13) of the 13 proteins that consist each of SEQ ID NOs: 3 to 16. Thus the invention provides an antibody that binds to at least 2 (e.g. to 3, 4, 5, 6, 7, 8, 9, 10, 11, 12 or all 13) of the 13 proteins that consist each of SEQ ID NOs: 3 to 16, SEQ ID NOs 99-113, and SEQ ID NOs 114-128. Antibodies that bind to only one of said group of 13 proteins are not encompassed by the present invention. Thus the invention provides an antibody that binds to at least 2 (e.g. to 3, 4, 5, 6, 7, 8, 9, 10, 11, 12, 13, 14, 15, 16, or all 17) of the 17 proteins that consist each of SEQ ID NOs: 3 to 16, 129, 133, 137 and 141, SEQ ID NOs 99-113, 130, 134, 138 and 142, and SEQ ID NOs 114-128, 131, 135, 139 and 143. In certain embodiments, at least one of the at least 2 or more proteins to which the antibody binds must be selected from one of the four proteins that consist of each of SEQ ID NOs: 129, 133, 137 and 141, SEQ ID NOs 130, 134, 138 and 142, and SEQ ID NOs 131, 135, 139 and 143. Antibodies that bind to only one of said group of 17 proteins are not encompassed by the present invention.

The invention also provides the use of such antibodies in therapy. The invention also provides the use of such antibodies in the manufacture of a medicament. The invention also provides a method for treating a mammal comprising the step of administering an effective amount of an antibody of the invention. As described above for immunogenic compositions, these methods and uses allow a mammal to be protected against *E. coli* infection.

The term "antibody" includes intact immunoglobulin molecules, as well as fragments thereof which are capable of binding an antigen. These include hybrid (chimeric) antibody molecules [211, 212]; F(ab')2 and F(ab) fragments and Fv molecules; non-covalent heterodimers [213, 214]; single-chain Fv molecules (sFv) [215]; dimeric and trimeric antibody fragment constructs; minibodies [216, 217]; humanized antibody molecules [218-220]; and any functional fragments obtained from such molecules, as well as antibodies obtained through non-conventional processes such as phage display. Preferably, the antibodies are monoclonal antibodies. Methods of obtaining monoclonal antibodies are well known in the art. Humanised or fully-human antibodies are preferred.

General

The practice of the present invention will employ, unless otherwise indicated, conventional methods of chemistry, biochemistry, molecular biology, immunology and pharmacology, within the skill of the art. Such techniques are explained fully in the literature. See, e.g., references 221-228, etc.

The term "comprising" encompasses "including" as well as "consisting" e.g. a composition "comprising" X may consist exclusively of X or may include something additional e.g. X+Y.

The term "about" in relation to a numerical value x means, for example, x±10%.

"GI" numbering is used herein. A GI number, or "GenInfo Identifier", is a series of digits assigned consecutively to each sequence record processed by NCBI when sequences are added to its databases. The GI number bears no resemblance to the accession number of the sequence record. When a sequence is updated (e.g. for correction, or to add more annotation or information) then it receives a new GI number. Thus the sequence associated with a given GI number is never changed:

References to a percentage sequence identity between two amino acid sequences means that, when aligned, that percentage of amino acids are the same in comparing the two sequences. This alignment and the percent homology or sequence identity can be determined using software programs known in the art, for example those described in section 7.7.18 of ref. 229. A preferred alignment is determined by the Smith-Waterman homology search algorithm using an affine gap search with a gap open penalty of 12 and a gap extension penalty of 2, BLOSUM matrix of 62. The Smith-Waterman homology search algorithm is disclosed in ref. 230.

One of skill in the art would understand that "isolated" means altered "by the hand of man" from its natural state, i.e., if it occurs in nature, it has been changed or removed from its original environment, or both. For example, a polynucleotide or a polypeptide naturally present in a living organism is not "isolated" when in such living organism, but the same polynucleotide or polypeptide separated from the coexisting materials of its natural state is "isolated," as the term is used in this disclosure. Further, a polynucleotide or polypeptide that is introduced into an organism by transformation, genetic manipulation or by any other recombinant method would be understood to be "isolated" even if it is still present in said organism, which organism may be living or non-living, except where such transformation, genetic manipulation or other recombinant method produces an organism that is otherwise indistinguishable from the naturally occurring organism.

BRIEF DESCRIPTION OF DRAWINGS

FIGS. 1A-K show a CLUSTALW alignment of SEQ ID NOs: 2 to 16. The N-terminal regions that may be removed to increase solubility while maintaining substantially the same immunogenicity are shown at the bottom of the alignment. The N-terminal region up to the gly-ser linker or gly-ser region is denoted with "G" and the proline-rich region is denoted with "P."

FIG. 2 shows the amino acid identity between pairs of sequences.

Figure 3:
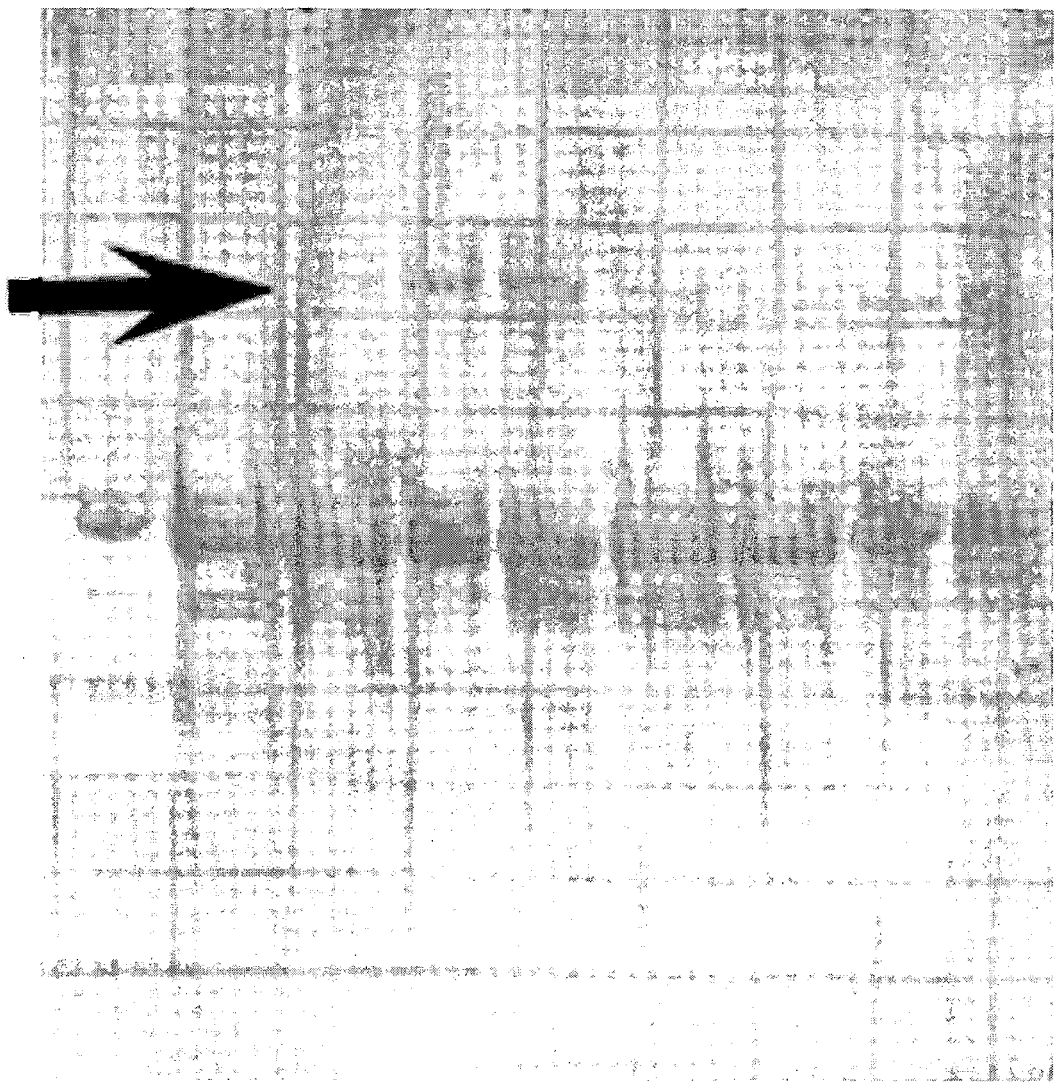
FIG. 3 shows gel analysis of purified protein, with high MW bands visible in the absence of DTT.

| BRIEF DESCRIPTION OF SEQUENCE LISTING | |
|---|---|
| SEQ ID | Description |
| 1 | Coding sequence from NMEC strain IHE3034 |
| 2 | Sequence from NMEC strain IHE3034 |
| 3 | Sequence from EAEC strain 101-1 (GI: 83587587) |
| 4 | Sequence from UPEC strain 536 (GI: 110643204) |
| 5 | Sequence from EIEC strain 53638 (GI: 75515237) |
| 6 | Sequence from ETEC strain B7A (GI: 75227618) |
| 7 | Sequence from EPEC strain E110019 (GI: 75239450) |
| 8 | Sequence from EPEC strain E22 (GI: 75259912) |
| 9 | Sequence from ETEC strain E24377A (GI: 157156747) |
| 10 | Sequence from UPEC strain F11 (GI: 75241179) |

-continued

| BRIEF DESCRIPTION OF SEQUENCE LISTING | |
|---|---|
| SEQ ID | Description |
| 11 | Sequence from ETEC strain H10407 |
| 12 | Sequence from EAEC strain O42 |
| 13 | Sequence from commensal strain HS (GI: 157162442) |
| 14 | Sequence from commensal strain W3110 (GI: 89109748) |
| 15 | Sequence from antibiotic-resistant strain SECEC |
| 16 | Sequence from EPEC strain E2348/69 |
| 17-95 | Fragments common to SEQ ID NOs: 2 to 15 |
| 96 | IC31 nucleotide |
| 97 | IC31 peptide |
| 98 | Optionally disclaimed N-terminus sequence |
| 99-113 | Representative deletions of the N-terminus of AcfD through the gly-ser linker or gly-ser region |
| 114-128 | Representative deletion of the N-terminus of AcfD through the proline rich region |
| 129 | Amino acid sequence from EAEC strain 55989 |
| 130 | Representative deletion of the N-terminus of AcfD from EAEC strain 55989 through the gly-ser linker or gly-ser region |
| 131 | Representative deletion of the N-terminus of AcfD from EAEC strain 55989 through the proline rich region |
| 132 | Nucleic acid sequence from EAEC strain 55989 |
| 133 | Amino acid sequence from UPEC strain IAI39 |
| 134 | Representative deletion of the N-terminus of AcfD from UPEC strain IAI39 through the gly-ser linker or gly-ser region |
| 135 | Representative deletion of the N-terminus of AcfD from UPEC strain IAI39 through the proline rich region |
| 136 | Nucleic acid sequence from UPEC strain IAI39 |
| 137 | Amino acid sequence from UPEC strain UMN026 |
| 138 | Representative deletion of the N-terminus of AcfD from UPEC strain UMN026 through the gly-ser linker or gly-ser region |
| 139 | Representative deletion of the N-terminus of AcfD from UPEC strain UMN026 through the proline rich region |
| 140 | Nucleic acid sequence from UPEC strain UMN026 |
| 141 | Amino acid sequence from NMEC strain S88 |
| 142 | Representative deletion of the N-terminus of AcfD from NMEC strain S88 through the gly-ser linker or gly-ser region |
| 143 | Representative deletion of the N-terminus of AcfD from NMEC strain S88 through the proline rich region |
| 144 | Nucleic acid sequence from NMEC strain S88 |

*Escherichia coli* 55989 (Diarrhea-associated isolate, no plasmid—SEQ ID NOs: 129, 130 (ΔG), 131 (ΔP), and 132): *Escherichia coli* 55989 is a clinical enteroaggregative isolate. Enteroaggregative *E. coli* strains adhere to mucosal cells and are an emerging cause of gastroenteritis. *Escherichia coli* IA139 (Urinary tract infection isolate, no plasmid SEQ ID NOs: 133, 134 (ΔG), 135 (ΔP), and 136): *Escherichia coli* IA139 is a serotype O7:K1 strain from a urinary tract infection. *Escherichia coli* UMN026 (Urinary tract infection isolate, 1 plasmid—SEQ ID NOs: 137, 138 (ΔG), 139 (ΔP), and 140): *Escherichia coli* UMN026 is a serotype O7:K1 clinical isolate. This strain is drug resistant.

*Escherichia coli* S88 (Meningitis isolate, no plasmid—SEQ ID NOs: 141, 142 (ΔG), 143 (ΔP), and 144): *Escherichia coli* S88 is a serotype O45:K1 strain isolated from a case of neonatal meningitis.

MODES FOR CARRYING OUT THE INVENTION

One of the antigens disclosed in reference 5 is annotated as accessory colonization factor D (AcfD) precursor (amino acid SEQ ID NO: 2 herein) from NMEC strain IHE3034. This protein has been expressed and purified, and it confers protection against ExPEC strains in a sepsis animal model.

Sequences were obtained for the orthologs in various other *E. coli* strains. The amino acid sequence seen in IHE3034 was also seen in strains APECO1 and UTI89, but 14 extra sequences were found (SEQ ID NOs: 3 to 16). FIG. 1 shows an alignment of SEQ ID NOs: 2 to 16. There are several stretches of conservation across the sequences (SEQ ID NOs: 17 to 95). The 30 N-terminal amino acids are 100% conserved, and these include the signal peptide (aa 1-23) and the N-terminus cysteine of the native lipoprotein.

Some strains had a frameshift mutation in the AcfD gene, resulting in no expression of the polypeptide. The acfD gene was totally absent from strains CFT073, EDL933, Sakai and B171.

FIG. 2 shows the % identity between the amino acid sequences. The labels are SEQ ID NOs, except for MG1655, RS218, DH10B, APECO1 and UTI89 where the strain name is used. The lowest level of identity (boxed in FIG. 2) was 85.9%, between SEQ ID NOs: 2 and 4 (both ExPEC strains).

The AcfD sequence from strain IHE3034 was cloned and then and expressed, from a plasmid as a recombinant His-tagged protein without a leader peptide, in an *E. coli* host. Protein was purified and analysed. Gel filtration showed a much higher molecular weight than predicted based solely on the amino acid sequence. Gel analysis in the absence of DTT, but not in its presence, shows higher molecular weight forms of the protein (FIG. 3). Thus the protein is likely to form oligomers.

Figure 4:
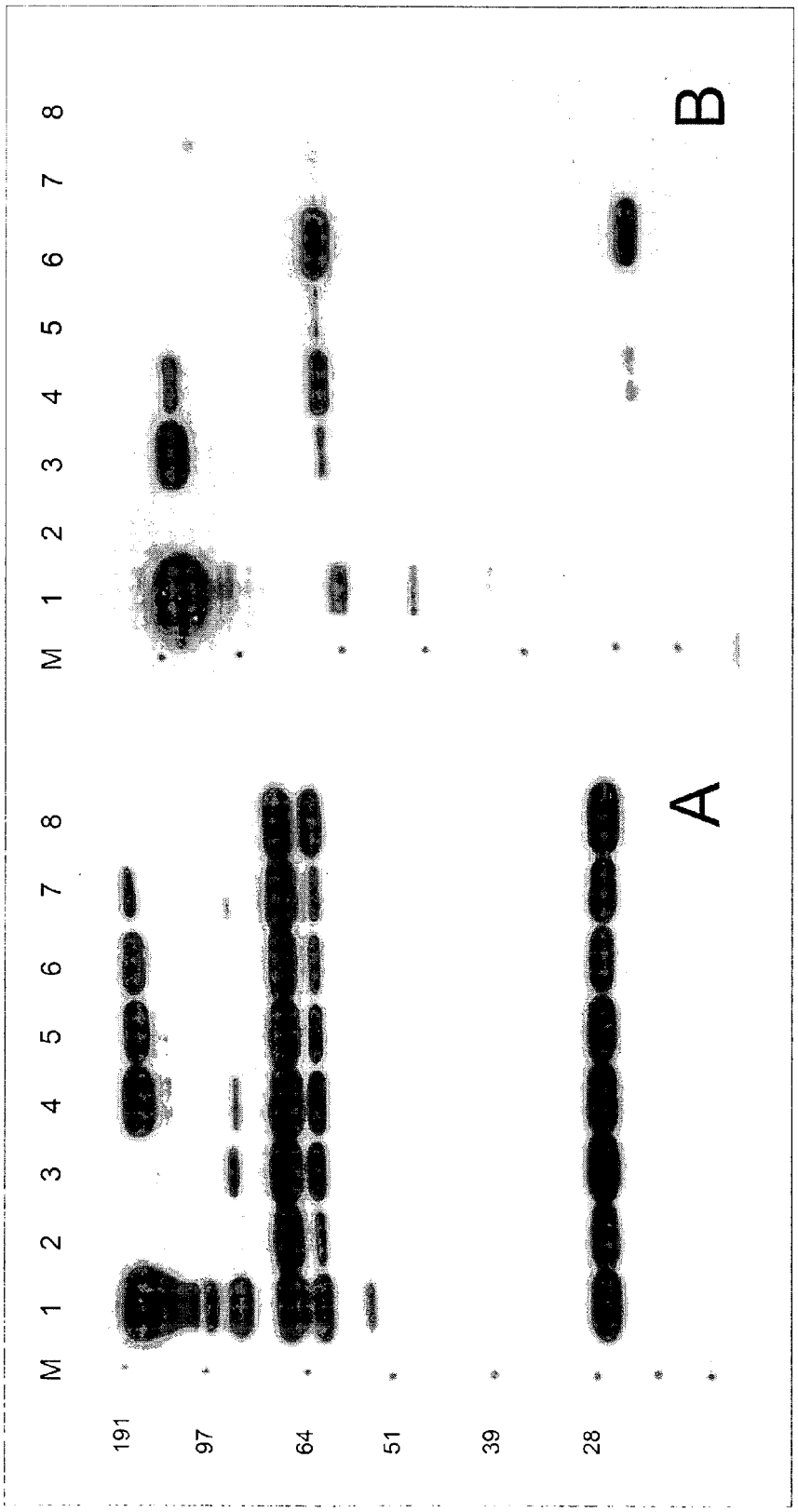
FIG. 4 shows the Western Blot of pathogenic and non pathogenic *E. coli* strains using an anti-AcfD serum. Panel (A) is a Western Blot of the total cell lysate. Panel (B) is a Western Blot of the supernatant from the culture. The lanes in each of panel (A) and (B) from left to right are as follows: Lane M—marker proteins with the molecular weight in kDa of each marker protein shown along the left side of panel (A); 1—IHE3034; 2—CFT073; 3—536; 4—BL21; 5—MG 1655; 6—W3110; 7—NISSLE1917; 8—IHE3034ΔActD. As observed from the analysis, pathogenic strains (IHE3034, lane 1; 536, lane 3) express and secrete AcfD while non-pathogenic strains (MG1655, lane 5; W3110, lane 6; Nissle 1917, lane 7) express the protein but its secretion is defective. Strains CFT073 (lane 2) and IHE3034DAcfD (lane 8) are used as negative control, since they don't harbor the acfD gene. BL21 strain (lane 4) is a lab strain used as positive control, since it expresses and secretes AcfD.

Sera raised against AcfD were used in western blots against total cell lysates (FIG. 4(A)) or culture supernatants precipitated with 60% TCA (FIG. 4(B)). The sera recognised a ~150 kDa protein in lysates from both pathogenic and commensal strains. They did not react with this band in lysates from CFT073 or from an AcfD knockout mutant of IHE3034. Reactivity with proteins in the supernatants indicates that the protein may be secreted.

CD1 mice (5 weeks old) were immunized sub-cutaneously using 20 μg of the antigen plus Freund's adjuvant (or other adjuvant as indicated below). The mice were inoculated at 0, 21, and 35 days. Fourteen days after the third inoculation, the mice were challenged with a lethal dose (LD80) of a pathogenic strain of *E. coli*. Blood was collected from the tail 24 hours after challenge to evaluate bacteremia. The mortality was monitored for four days post-challenge. The protection rate may be calculated as (% dead in control group (no immunization)−% dead in experimental group (immunized))/% dead in control group×100.

In further experiments using an aluminium salt adjuvant, to which the protein adsorbed completely, 75% of mice were protected vs. 0% in the control groups. The deaths in both groups occurred within 1 day of lethal challenge.

In further experiments, the recombinant host was grown under two different $pO_2$ conditions during expression. Under both conditions the protein was visible in two pools with a different charge. No significant differences were seen in the protective efficacy of the four different pools of protein.

Increased Solubility

Figure 5:
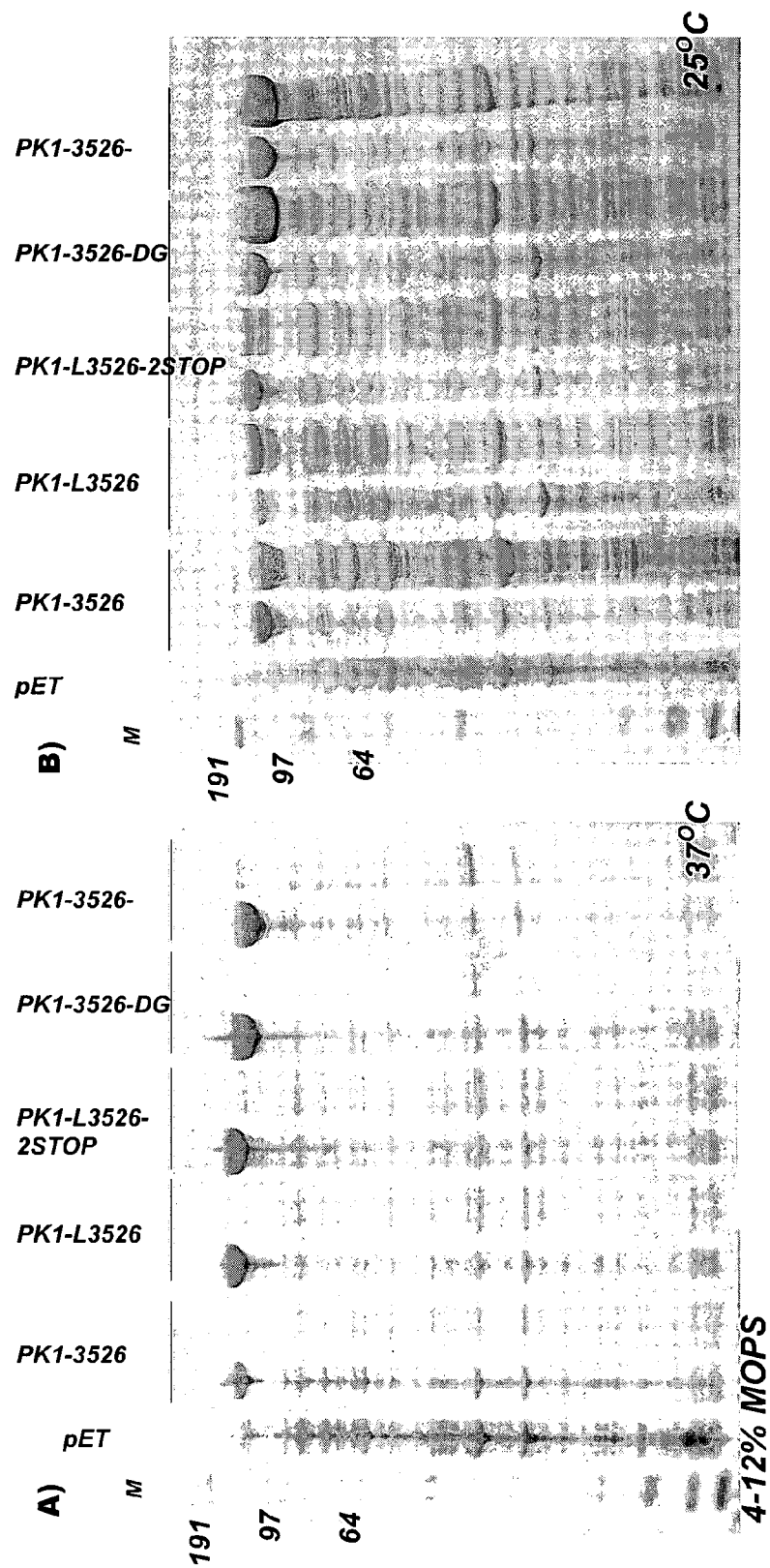
FIG. 5 shows a comparison of solubility of the AcfD protein and various fragments of the protein. Panel (A) is an SDS-PAGE gradient gel (4-12% MOPS buffer) of samples at 37° C. comparing the pellet (left lane for each protein or fragment) to the supernatant (right lane for each protein or fragment. The lanes from left to right are: Molecular weight markers (191 kDa, 97 kDa and 64 kDa bands are labelled), control bacteria transformed with the pET expression vector with no insert, bacterial expression of 3526 (his tag+leader peptide removed), bacterial expression of L3526 (his tag+full length), bacterial expression of L3526-2stop (full length), bacterial expression of 3526-DG (his tag+removal of the N-terminus of AcfD to the flexible glycine-serine linker), and bacterial expression of 3526-DP (his tag+removal of the N-terminus of AcfD through the proline rich region). Panel (B) is an SDS-PAGE gradient gel (4-12% MOPS buffer) of samples at 25° C. following the same order for the lanes as panel (A).

Unexpectedly, AcfD protein displayed low solubility even though the protein is a secreted protein. As shown in FIG. 5(B), removal of the N-terminus of AcfD through the gly-ser linker or gly-ser region significantly increased solubility when expressed at 25° C. (See pK1-3526-DG FIG. 5(B)). Similarly removal of the N-terminus of AcfD through the proline rich region significantly increased solubility when expressed at 25° C. (See pK1-3526-DP FIG. 5(B)).

To confirm that both fragments had substantially the same immunogenicity as the full length AcfD, the fragments were purified. The purified fragments were used in three immunization experiments in mice, adjuvanted with Freund's complete adjuvant Immunized mice were then challenged with a lethal dose of *E. coli*. Immunization with AcfD with the N-terminus through the gly-ser linker or gly-ser region removed protected 100% of the mice from death, whereas death occurred in 90% of the animals in the non-immunized control group. Immunization with AcfD with the N-terminus through the proline rich region removed protected 90% of the mice from death, whereas death occurred in 90% of the animals in the non-immunized control group.

Expression and Purification

Figure 6:
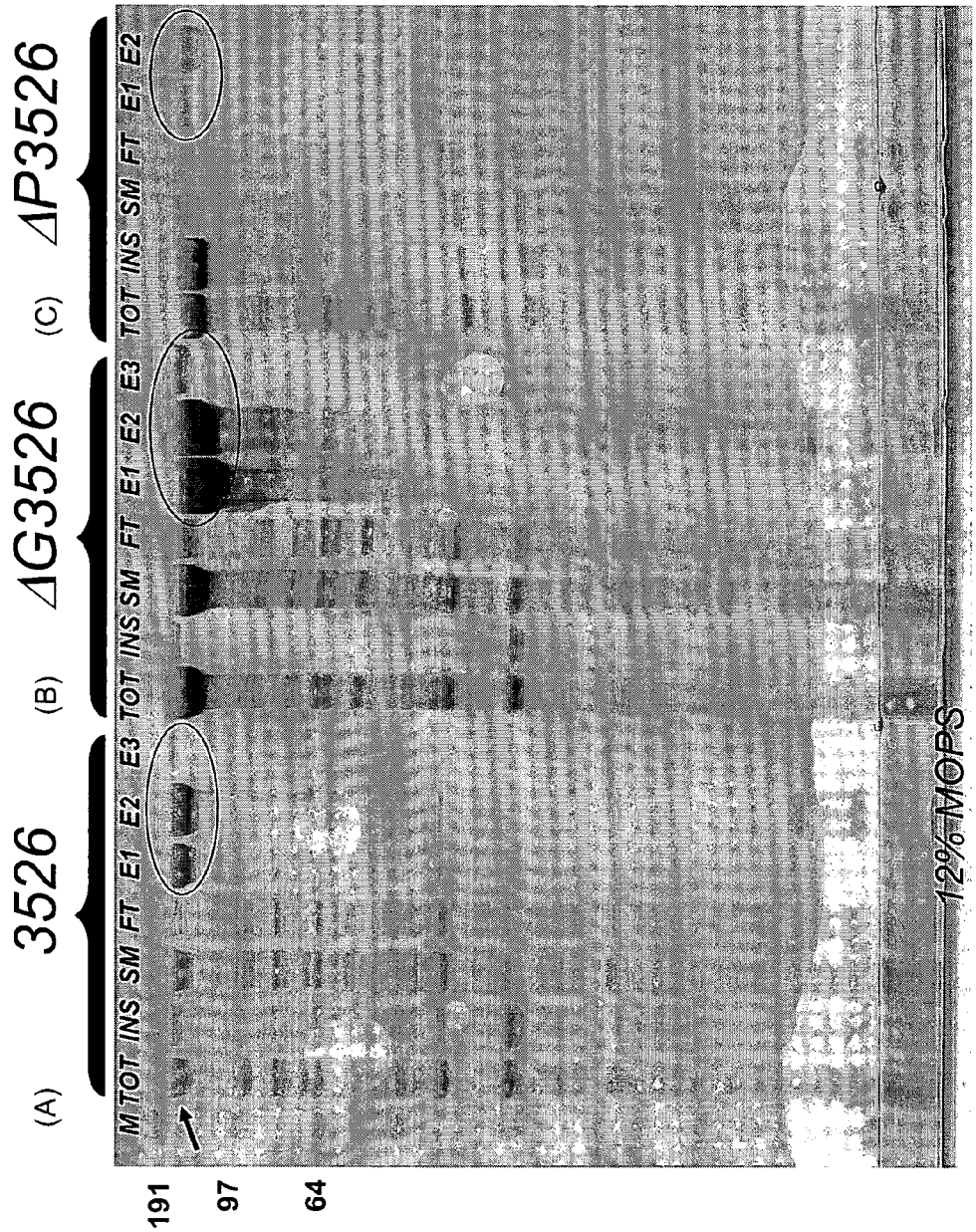
FIG. 6 shows a comparison of expression and purification of the AcfD protein and various fragments of the protein. Panel (A) is an SDS-PAGE gel (12% MOPS buffer) of samples at from bacteria expressing 3526 (his tag+leader peptide removed), cultured a 25° C. comparing factions from various stages of the purification. The lanes from left to right are: M: Molecular weight markers (191 kDa, 97 kDa and 64 kDa bands are labelled), TOT: total bacterial lysate, INS: insoluble fraction of bacterial lysate, SM: soluble fraction of bacterial lysate, FT: flow through from Nickel column; E1, E2, and E3 three eltions with 500 mM imidazole buffer. Panel (B) is an SDS-PAGE gel (12% MOPS buffer) of samples at from bacteria expressing ΔG3526 (his tag+removal of the N-terminus of AcfD to the flexible glycine-serine linker) cultured a 25° C. comparing factions from various stages of the purification. The lanes from left to right are: M: Molecular weight markers (191 kDa, 97 kDa and 64 kDa bands are labelled), TOT: total bacterial lysate, INS: insoluble fraction of bacterial lysate, SM: soluble fraction of bacterial lysate, FT: flow through from Nickel column; E1, E2, and E3 three eltions with 500 mM imidazole buffer. Panel (C) is an SDS-PAGE gel (12% MOPS buffer) of samples at from bacteria expressing ΔP3526 (his tag+removal of the N-terminus of AcfD through the proline rich region), cultured a 25° C. comparing factions from various stages of the purification. The lanes from left to right are: M: Molecular weight markers (191 kDa, 97 kDa and 64 kDa bands are labelled), TOT: total bacterial lysate, INS: insoluble fraction of bacterial lysate, SM: soluble fraction of bacterial lysate, FT: flow through from Nickel column; E1, E2, and E3 three elutions with 500 mM imidazole buffer.
Figure 7:
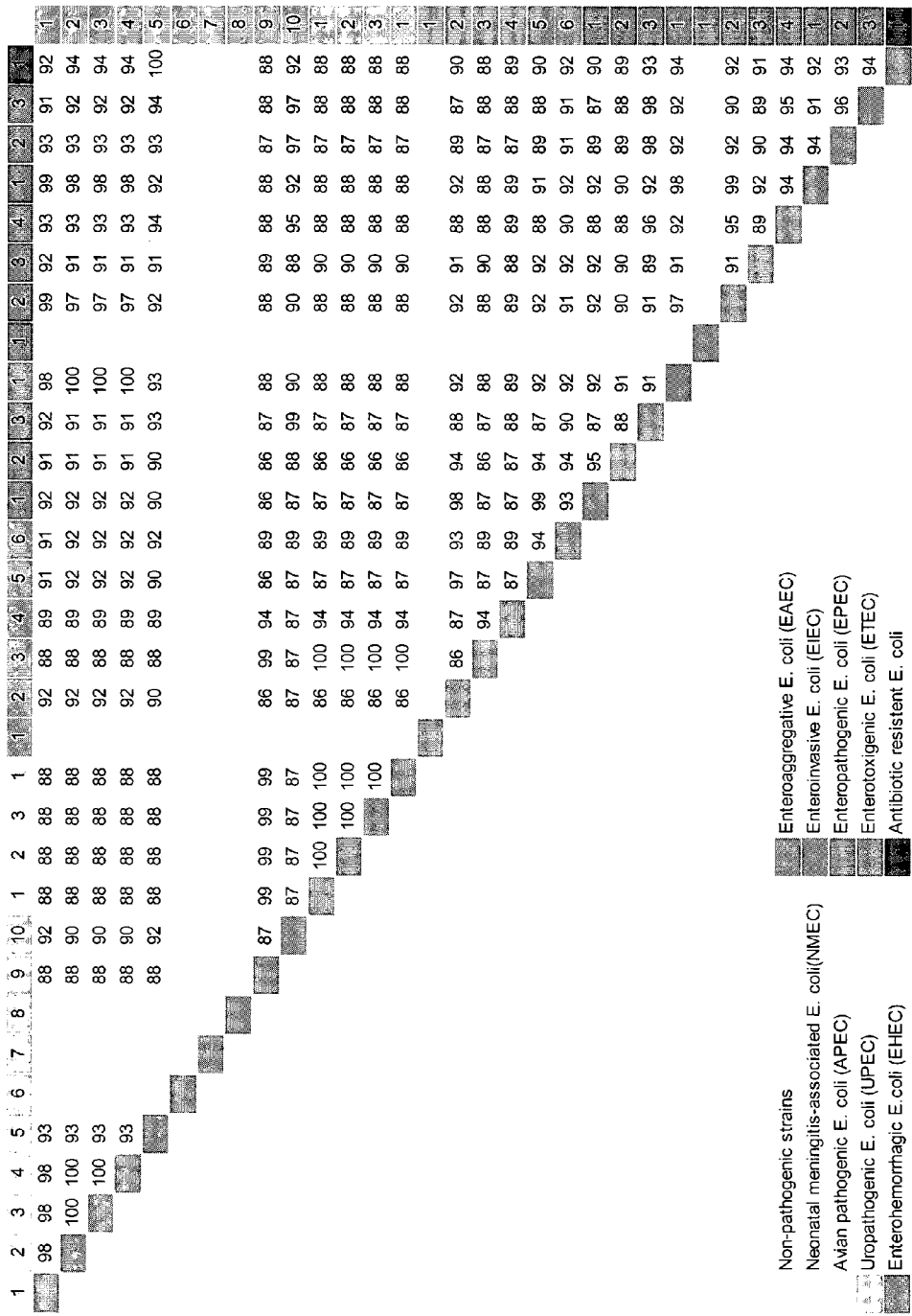
FIG. 7 shows the amino acid identity between additional pairs of sequences. Sixteen Enterohemorrhagic *E. coli* (EHEC) were not found to have AcfD genes (not shown). The sequences (where represented) from left to right or top to bottom are as follows: 10 non-pathogenic or commensal strains (1: a commensal *E. coli* strain, 2: DH10B strain, 3: MG1655 strain, 4: W3110 strain (SEQ ID NO:14); 5: HS strain (SEQ ID NO:13); 9: another commensal *E. coli* strain; and 10: yet another commensal *E. coli* strain); three NMEC strains (1: NMEC strain RS218; 2: NMEC strain IHE3034 (SEQ ID NO:2); and 3: NMEC strain S88 (SEQ ID NO:141)); one APEC strain (1: APEC O1 strain); six UPEC strains (2: UPEC strain 536 (SEQ ID NO:4); 3: UTI89; 4: UPEC strain F11 (SEQ ID NO:10); 5: UPEC strain IA139 (SEQ ID NO:133); and 6: UPEC strain UMNO26 (SEQ ID NO:137)); three EAEC strains (1: EAEC strain 101-1 (SEQ ID NO:3); 2: EAEC strain O42 (SEQ ID NO:12; and 3: EAEC strain 55989 (SEQ ID NO:129)); one EIEC strain (1: EIEC strain 53638 (SEQ ID NO:5)); four EPEC strains (2: EPEC strain E22 (SEQ ID NO: 8)); 3: EPEC strain E2348/69 (SEQ ID NO:16); and 4: EPEC strain E110019 (SEQ ID NO:7)); three ETEC strains (1: ETEC strain B7A (SEQ ID NO:6); 2: ETEC strain E24377A (SEQ ID NO:9); and 3: ETEC strain H10407 (SEQ ID NO:11)); and one antibiotic resistant strain (1: antibiotic-resistant strain SECEC (SEQ ID NO:15)).

Bacteria with one of the three constructs expressing his-tagged variants of AcfD were cultured in 30 ml of medium and induced to express the AcfD variant at 25° C. (AcfD without the leader peptide (3526), AcfD with the N-terminus removed through the gly-ser linker or gly-ser region (ΔG3526), and AcfD with the N-terminus removed through the proline rich region (ΔG3526)). The bacteria was harvested and lysed by sonication. The soluble fractions were isolated and loaded on an IMAC column. The column was washed three times with 20 mM imidazole buffer. The AcfD variants were then eluted with three washes of 500 mM imidazole buffer. As shown in FIG. 6, removal of the N-terminus of AcfD through the gly-ser linker or gly-ser region significantly increased solubility and yield of purified protein. The yield obtained was estimated by Bradford assay to be as follows: 0.18 mg of 3526 and 2.34 mg ΔG3526.

It will be understood that the invention has been described by way of example only and modifications may be made whilst remaining within the scope and spirit of the invention.

REFERENCES

[1] Kaper et al. (2004) *Nat Rev Microbiol.* 2(2):123-40.
[2] Anjum et al. (2007) *Appl Environ Microbiol* 73; 5692-7.
[3] Russo & Johnson (2000) *J Infect Dis* 181:1753-1754.
[4] Smith et al. (2007) *Foodborne Pathogens And Disease* 4:134-63.
[5] WO2006/089264.
[6] WO2006/091517.
[7] Needleman & Wunsch (1970) *J. Mol. Biol.* 48, 443-453.
[8] Rice et al. (2000) *Trends Genet* 16:276-277.
[9] Needleman & Wunsch (1970) *J. Mol. Biol.* 48, 443-453.
[10] Rice et al. (2000) *Trends Genet* 16:276-277.
[11] Geysen et al. (1984) *PNAS USA* 81:3998-4002.
[12] Carter (1994) *Methods Mol Biol* 36:207-23.
[13] Jameson, B A et al. 1988, *CABIOS* 4(1):181-186.
[14] Raddrizzani & Hammer (2000) *Brief Bioinform* 1(2): 179-89.
[15] Bublil et al. (2007) *Proteins* 68(1):294-304.
[16] De Lalla et al. (1999) *J. Immunol.* 163:1725-29.
[17] Kwok et al. (2001) *Trends Immunol* 22:583-88.
[18] Brusic et al. (1998) *Bioinformatics* 14(2):121-30
[19] Meister et al. (1995) *Vaccine* 13(6):581-91.
[20] Roberts et al. (1996) *AIDS Res Hum Retroviruses* 12(7): 593-610.
[21] Maksyutov & Zagrebelnaya (1993) *Comput Appl Biosci* 9(3):291-7.
[22] Feller & de la Cruz (1991) *Nature* 349(6311):720-1.
[23] Hopp (1993) *Peptide Research* 6:183-190.
[24] Welling et al. (1985) *FEBS Lett.* 188:215-218.
[25] Davenport et al. (1995) *Immunogenetics* 42:392-297.
[26] Tsurui & Takahashi (2007) *J Pharmacol Sci.* 105(4): 299-316.
[27] Tong et al. (2007) *Brief Bioinform.* 8(2):96-108.
[28] Schirle et al. (2001) *J Immunol Methods.* 257(1-2):1-16.
[29] Chen et al. (2007) *Amino Acids* 33(3):423-8.
[30] U.S. Pat. No. 5,707,829
[31] *Current Protocols in Molecular Biology* (F. M. Ausubel et al. eds., 1987) Supplement 30.

[32] *Vaccine Design: The Subunit and Adjuvant Approach* (eds. Powell & Newman) Plenum Press 1995 (ISBN 0-306-44867-X).
[33] *Vaccine Adjuvants: Preparation Methods and Research Protocols* (Volume 42 of *Methods in Molecular Medicine* series). ISBN: 1-59259-083-7. Ed. O'Hagan.
[34] U.S. Pat. No. 6,355,271.
[35] WO00/23105.
[36] WO90/14837.
[37] WO90/14837.
[38] Podda & Del Giudice (2003) *Expert Rev Vaccines* 2:197-203.
[39] Podda (2001) *Vaccine* 19: 2673-2680.
[40] *Vaccine Design: The Subunit and Adjuvant Approach* (eds. Powell & Newman) Plenum Press 1995 (ISBN 0-306-44867-X).
[41] *Vaccine Adjuvants: Preparation Methods and Research Protocols* (Volume 42 of *Methods in Molecular Medicine* series). ISBN: 1-59259-083-7. Ed. O'Hagan.
[42] Allison & Byars (1992) *Res Immunol* 143:519-25.
[43] Hariharan et al. (1995) *Cancer Res* 55:3486-9.
[44] US-2007/014805.
[45] Suli et al. (2004) *Vaccine* 22(25-26):3464-9.
[46] WO95/11700.
[47] U.S. Pat. No. 6,080,725.
[48] WO2005/097181.
[49] WO2006/113373.
[50] Han et al. (2005) *Impact of Vitamin E on Immune Function and Infectious Diseases in the Aged at Nutrition, Immune functions and Health* EuroConference, Paris, 9-10 Jun. 2005.
[51] U.S. Pat. No. 6,630,161.
[52] U.S. Pat. No. 5,057,540.
[53] WO96/33739.
[54] EP-A-0109942.
[55] WO96/11711.
[56] WO00/07621.
[57] Barr et al. (1998) *Advanced Drug Delivery Reviews* 32:247-271.
[58] Sjolanderet et al. (1998) *Advanced Drug Delivery Reviews* 32:321-338.
[59] Niikura et al. (2002) *Virology* 293:273-280.
[60] Lenz et al. (2001) *J Immunol* 166:5346-5355.
[61] Pinto et al. (2003) *J Infect Dis* 188:327-338.
[62] Gerber et al. (2001) *J Virol* 75:4752-4760.
[63] WO03/024480.
[64] WO03/024481.
[65] Gluck et al. (2002) *Vaccine* 20:B10-B16.
[66] EP-A-0689454.
[67] Johnson et al. (1999) *Bioorg Med Chem Lett* 9:2273-2278.
[68] Evans et al. (2003) *Expert Rev Vaccines* 2:219-229.
[69] Meraldi et al. (2003) *Vaccine* 21:2485-2491.
[70] Pajak et al. (2003) *Vaccine* 21:836-842.
[71] Kandimalla et al. (2003) *Nucleic Acids Research* 31:2393-2400.
[72] WO02/26757.
[73] WO99/62923.
[74] Krieg (2003) *Nature Medicine* 9:831-835.
[75] McCluskie et al. (2002) *FEMS Immunology and Medical Microbiology* 32:179-185.
[76] WO98/40100.
[77] U.S. Pat. No. 6,207,646.
[78] U.S. Pat. No. 6,239,116.
[79] U.S. Pat. No. 6,429,199.
[80] Kandimalla et al. (2003) *Biochemical Society Transactions* 31 (part 3):654-658.
[81] Blackwell et al. (2003) *J Immunol* 170:4061-4068.
[82] Krieg (2002) *Trends Immunol* 23:64-65.
[83] WO01/95935.
[84] Kandimalla et al. (2003) *BBRC* 306:948-953.
[85] Bhagat et al. (2003) *BBRC* 300:853-861.
[86] WO03/035836.
[87] WO01/22972.
[88] Schellack et al. (2006) *Vaccine* 24:5461-72.
[89] WO95/17211.
[90] WO98/42375.
[91] Beignon et al. (2002) *Infect Immun* 70:3012-3019.
[92] Pizza et al. (2001) *Vaccine* 19:2534-2541.
[93] Pizza et al. (2000) *Int J Med Microbiol* 290:455-461.
[94] Scharton-Kersten et al. (2000) *Infect Immun* 68:5306-5313.
[95] Ryan et al. (1999) *Infect Immun* 67:6270-6280.
[96] Partidos et al. (1999) *Immunol Lett* 67:209-216.
[97] Peppoloni et al. (2003) *Expert Rev Vaccines* 2:285-293.
[98] Pine et al. (2002) *J Control Release* 85:263-270.
[99] Tebbey et al. (2000) *Vaccine* 18:2723-34.
[100] Domenighini et al. (1995) *Mol Microbiol* 15:1165-1167.
[101] WO99/40936.
[102] WO99/44636.
[103] Singh et al] (2001) *J Cont Release* 70:267-276.
[104] WO99/27960.
[105] U.S. Pat. No. 6,090,406.
[106] U.S. Pat. No. 5,916,588.
[107] EP-A-0626169.
[108] WO99/52549.
[109] WO01/21207.
[110] WO01/21152.
[111] Andrianov et al. (1998) *Biomaterials* 19:109-115.
[112] Payne et al. (1998) *Adv Drug Delivery Review* 31:185-196.
[113] U.S. Pat. No. 4,680,338.
[114] U.S. Pat. No. 4,988,815.
[115] WO92/15582.
[116] Stanley (2002) *Clin Exp Dermatol* 27:571-577.
[117] Wu et al. (2004) *Antiviral Res.* 64(2):79-83.
[118] Vasilakos et al. (2000) *Cell Immunol.* 204(1):64-74.
[119] U.S. Pat. Nos. 4,689,338, 4,929,624, 5,238,944, 5,266,575, 5,268,376, 5,346,905, 5,352,784, 5,389,640, 5,395,937, 5,482,936, 5,494,916, 5,525,612, 6,083,505, 6,440,992, 6,627,640, 6,656,938, 6,660,735, 6,660,747, 6,664,260, 6,664,264, 6,664,265, 6,667,312, 6,670,372, 6,677,347, 6,677,348, 6,677,349, 6,683,088, 6,703,402, 6,743,920, 6,800,624, 6,809,203, 6,888,000 and 6,924,293.
[120] Jones (2003) *Curr Opin Investig Drugs* 4:214-218.
[121] WO03/011223.
[122] Johnson et al. (1999) *Bioorg Med Chem Lett* 9:2273-2278.
[123] Evans et al. (2003) *Expert Rev Vaccines* 2:219-229.
[124] WO2004/060308.
[125] WO2004/064759.
[126] U.S. Pat. No. 6,924,271.
[127] US2005/0070556.
[128] U.S. Pat. No. 5,658,731.
[129] U.S. Pat. No. 5,011,828.
[130] WO2004/87153.
[131] U.S. Pat. No. 6,605,617.
[132] WO02/18383.
[133] WO2004/018455.
[134] WO03/082272.
[135] Wong et al. (2003) *J Clin Pharmacol* 43(7):735-42.
[136] US2005/0215517.
[137] Dyakonova et al. (2004) Int Immunopharmacol 4(13):1615-23.
[138] FR-2859633.
[139] Signorelli & Hadden (2003) *Int Immunopharmacol* 3(8):1177-86.
[140] WO2004/064715.

[141] De Libero et al, *Nature Reviews Immunology,* 2005, 5: 485-496
[142] U.S. Pat. No. 5,936,076.
[143] Oki et al, *J. Clin. Investig.,* 113: 1631-1640
[144] US2005/0192248
[145] Yang et al, *Angew. Chem. Int. Ed.,* 2004, 43: 3818-3822
[146] WO2005/102049
[147] Goff et al, *J. Am. Chem., Soc.,* 2004, 126: 13602-13603
[148] WO03/105769
[149] Cooper (1995) *Pharm Biotechnol* 6:559-80.
[150] WO99/11241.
[151] WO94/00153.
[152] WO98/57659.
[153] European patent applications 0835318, 0735898 and 0761231.
[154] Durant et al. (2007) *Infect Immun* 75:1916-25.
[155] WO02/081653.
[156] Donnelly et al. (1997) *Annu Rev Immunol* 15:617-648.
[157] Strugnell et al. (1997) *Immunol Cell Biol* 75(4):364-369.
[158] Cui (2005) *Adv Genet* 54:257-89.
[159] Robinson & Torres (1997) *Seminars in Immunol* 9:271-283.
[160] Brunham et al. (2000) *J Infect Dis* 181 Suppl 3:S538-43.
[161] Svanholm et al. (2000) *Scand J Immunol* 51(4):345-53.
[162] *DNA Vaccination—Genetic Vaccination* (1998) eds. Koprowski et al. (ISBN 3540633928).
[163] *Gene Vaccination: Theory and Practice* (1998) ed. Raz (ISBN 3540644288).
[164] Findeis et al., *Trends Biotechnol.* (1993) 11:202
[165] Chiou et al. (1994) *Gene Therapeutics: Methods And Applications Of Direct Gene Transfer.* ed. Wolff
[166] Wu et al., *J. Biol. Chem.* (1988) 263:621
[167] Wu et al., *J. Biol. Chem.* (1994) 269:542
[168] Zenke et al., *Proc. Natl. Acad. Sci. (USA)* (1990) 87:3655
[169] Wu et al., *J. Biol. Chem.* (1991) 266:338
[170] Jolly, *Cancer Gene Therapy* (1994) 1:51
[171] Kimura, *Human Gene Therapy* (1994) 5:845
[172] Connelly, *Human Gene Therapy* (1995) 1:185
[173] Kaplitt, *Nature Genetics* (1994) 6:148
[174] WO 90/07936.
[175] WO 94/03622.
[176] WO 93/25698.
[177] WO 93/25234.
[178] U.S. Pat. No. 5,219,740.
[179] WO 93/11230.
[180] WO 93/10218.
[181] U.S. Pat. No. 4,777,127.
[182] GB Patent No. 2,200,651.
[183] EP-A-0345242.
[184] WO 91/02805.
[185] WO 94/12649.
[186] WO 93/03769.
[187] WO 93/19191.
[188] WO 94/28938.
[189] WO 95/11984.
[190] WO 95/00655.
[191] Curiel, *Hum. Gene Ther.* (1992) 3:147
[192] Wu, *J. Biol. Chem.* (1989) 264:16985
[193] U.S. Pat. No. 5,814,482.
[194] WO 95/07994.
[195] WO 96/17072.
[196] WO 95/30763.
[197] WO 97/42338.
[198] WO 90/11092.
[199] U.S. Pat. No. 5,580,859
[200] U.S. Pat. No. 5,422,120
[201] WO 95/13796.
[202] WO 94/23697.
[203] WO 91/14445.
[204] EP-0524968.
[205] Philip, *Mol. Cell Biol.* (1994) 14:2411
[206] Woffendin, *Proc. Natl. Acad. Sci.* (1994) 91:11581
[207] U.S. Pat. No. 5,206,152.
[208] WO 92/11033.
[209] U.S. Pat. No. 5,149,655.
[210] Brandt et al. (2006) *J Antimicrob Chemother.* 58(6): 1291-4. Epub 2006 Oct. 26
[211] Winter et al., (1991) *Nature* 349:293-99
[212] U.S. Pat. No. 4,816,567.
[213] Inbar et al., (1972) *Proc. Natl. Acad. Sci. U.S.A.* 69:2659-62.
[214] Ehrlich et al., (1980) *Biochem* 19:4091-96.
[215] Huston et al., (1988) *Proc. Natl. Acad. Sci. U.S.A.* 85:5897-83.
[216] Pack et al., (1992) *Biochem* 31, 1579-84.
[217] Cumber et al., (1992) *J. Immunology* 149B, 120-26.
[218] Riechmann et al., (1988) *Nature* 332, 323-27.
[219] Verhoeyan et al., (1988) *Science* 239, 1534-36.
[220] GB 2,276,169.
[221] Gennaro (2000) *Remington: The Science and Practice of Pharmacy.* 20th edition, ISBN: 0683306472.
[222] *Methods In Enzymology* (S. Colowick and N. Kaplan, eds., Academic Press, Inc.)
[223] *Handbook of Experimental Immunology,* Vols. I-IV (D. M. Weir and C. C. Blackwell, eds, 1986, Blackwell Scientific Publications)
[224] Sambrook et al. (2001) *Molecular Cloning: A Laboratory Manual,* 3rd edition (Cold Spring Harbor Laboratory Press).
[225] *Handbook of Surface and Colloidal Chemistry* (Birdi, K. S. ed., CRC Press, 1997)
[226] Ausubel et al. (eds) (2002) *Short protocols in molecular biology,* 5th edition (Current Protocols).
[227] *Molecular Biology Techniques: An Intensive Laboratory Course,* (Ream et al., eds., 1998, Academic Press)
[228] *PCR (Introduction to Biotechniques Series),* 2nd ed. (Newton & Graham eds., 1997, Springer Verlag)
[229] *Current Protocols in Molecular Biology* (F. M. Ausubel et al., eds., 1987) Supplement 30
[230] Smith & Waterman (1981) *Adv. Appl. Math.* 2: 482-489.

SEQUENCE LISTING (144 sequences)

SEQ ID NO: 1 - DNA, 4581 bp, Escherichia coli
ttgtcacttgcgttattaatgaataagaaatttaaatataagaaatcgcttttagcggctattttaagcgcaaccctgttagccggttgtgatggtggtggttcaggatcgtcctccgatacgccgtctgtagattctggatcagggactttgccggaagtgaaacccgatccaacaccaaccccggagccgacacctgagccgacgccggacccagaacctacgccggatccaacacctgatcctgagccgacaccagaaccggagccagaacctgttcctacgaaaacgggttatctgaccctgggcggaagccagcgggtaactggtgctacctgtaatggtgaatccagcgatggctttacctttacgccaggcaataccgtgagttgtgtggtgggcagtacgaccattgcaacattcaacacccagtcagaagctgcgcgtagcctgcgtgcggttgacaaagtgtcgtttagcctggaggacgcgcaggagctggcgaattctgaaaataagaaaaccaacgccatctctctggtgacgtccagcgacagttgccccgcagatgcagaacagctttgtcttactttctcgtcagtggttgatcgcgcgcgatttgaaaaactgtataagcaaattgatctggcaacagacaatttcagcaagctggtcaatgaagaggtggaaaacaatgctgcgactgataaagcgccgtccacccatacctcaacggtagtgccagtcacgacagagggaacaaaaccggatctgaacgcgtccttcgtgtcggctaacgcggaacagttttatcagtatcaacccactgaaatcattctttccgaaggccaactggtggatagcctggggaacggtgttgctggcgttgactactacaccaattcaggccgtggcgtaactgacgaaaacggtaaattttcctttagctggggcgaaaccatctcctttggtatcgatacctttgaactgggctcagtacgtggcaataagtcgaccattgcgctgactgaattgggtgatgaagttcgcggggcaaatatcgatcagctcattcatcgttattcgacgactggtcaaaataatactcgtgttgttccggacgatgtacgcaaggtctttgccgaatatcccaacgtgatcaacgagataatcaatctttcgttatccaacggtgcgacgctggatgaaggcgatcaaaacgttgtgctgcctaacgaatttatcgagcagtttaagacgggtcaggccaaagagatcgataccgcgatttgtgcgaaaaccgacggttgtaacgaggctcgctggttctcgctgacaacgcgcaatgttaatgacggccagattcagggcgttattaacaagctgtggggcgtggatacgaactatcagtctgtcagcaagttccacgtcttccatgactctaccaacttctatggcagcaccggtaacgcgcgcggtcaggcggtggtaaatatctccaactcggcattcccgattctgatggcgcgtaatgataaaaactactggctggcgtttggcgaaaaacgcgcctgggataaaaatgagctggcgtacattacggaagcgccttccattgtgcagccagagaacgttacgcgcgatactgcgactttcaacctgccgtttatttcgctggggcaagtcggtgaaggcaaactgatggttatcggtaacccgcactacaacagcatcctgcgttgcccgaacggttacagttggggcggtggtgttaatagtaaaggtgagtgtacgctcagcggtgattctgatgacatgaagcactttatgcagaacgtactgcgctacttgtcaaatgacatctggcagccaaataccaagagcatcatgactgtcggcaccaacctggagaacgtttatttcaaaaaagcgggccaggtattgggaaatagtgcaccatttgctttccatgaggatttcactggtatcacggttaaacagttgaccagctatggcgatctgaatccggaagagattccgttgctgatcctcaacggctttgaatatgtgactcagtggtctggcgatccctatgctgtgcctctgcgtgcagataccagcaaaccgaagctgactcagcaggatgtgaccgatctgatcgcttatctgaacaaaggtggctcggtgctgatcatggaaaacgtgatgagcaatcttaaggaagagagcgcgtccagttttgtgcgtctgctggatgccgcgggtctgtcaatggctctgaacaaatcggtggtgaacaacgatccgcaagggtatccggatcgcgttcgtcagcgtcgcgcgactggcatttgggtttatgaacgttatcctgctgcagacggcgcgcaaccgccgtacaccatcgacccaaatacaggggaagtgacctggaaataccagcaagacaacaagcctgatgacaagccgaaactggaagttgcgagctggcaggaggaagttgagggcaaacaggtaacgcgttatgcctttattgatgaagcggaatacacaacagaagaatctctggaagcggcaaaggcaaaaatctttgagaagtttcctgggttacaggagtgtaaggactcgacttaccattacgagattaactgtttggagcgccgcccaggcacggatgttccggtaacaggtggcatgtatgttccgcgctatacgcaactgaatcttgacgccgacaccgcgaaagcgatggtgcaggcggcggatttaggcaccaacattcagcgcctgtatcagcatgagctttatttccgtaccaaaggcagtaaaggtgagcgtctgaacagtgttgatctggaacgtctgtaccagaacatgtcggtctggctgtggaacgatacgaaatatcgttacgaagagggcaaggaagatgagctgggctttaaaacgttcaccgagttcctgaactgctacgccaatgatgcctatgcaggcggcaccaagtgctccgcagatctgaaaaaatcgctggtcgataacaacatgatctacggtgacggtagcagcaaagcgggcatgatgaacccaagctatccgctcaactatatggaaaaaccgctgacgcgtctgatgctgggccgttcctggtgggatctgaacattaaggttgatgtggagaagtacccaggatccgtatcggcaaagggtgagagcgttacggaaaacatcagcctgtactcgaatccgaccaaatggtttgcgggtaacatgcagtcaaccggcctgtgggcaccggcccagcaggacgtcaccattaagtcttcggcgtcagtcccagtgactgttaccgtggcgctggctgacgacctgactggacgtgagaagcatgaagttgcgctgaaccgtccgccaagagtgactaaaacgtatactctggaggctaacggtgaagtgaccttcaaggtgccttatggtggtctgatttatatcaagggcgacagtaaggatgatgtttctgctaacttcacctttaccggtgtagtaaaagcgccgttctataaagacggcgaatggaaaaacgatctggactcaccggcgccgctgggcgagctggagtctgcgtcgttcgtctataccacgccgaagaagaaccttgaggccagcaatttcactggtggtgtagcagaattcgctaaagatctggatacctttgccagctcgatgaatgacttctacggtcgtaatgatgaagacggtaagcaccggatgtttacctataaaaacttgacggggcacaagcatcgtttcaccaacgatgtgcagatctccatcggtgatgcgcactcgggttatccggtaatgaacagcagcttctcgacgaacagcaccacgctgccgacgacgccgctgaacgactggctgatttggcacgaagtcggtcataacgctgcagaaacaccgctgaacgtaccgggtgcaactgaagtggcgaacaacgtgctggcgctgtacatgcaggatcgctatctcggtaagatgaaccgtgtcgctgacgacattaccgtcgcgccggaatatctggacgagagcaacggtcaggcctgggcgcgcggcggtgcgggtgaccgtctgctgatgtacgcacagttgaaggagtgggcagaggaaaactttgatatcaaacagtggtatccagatggtgagctgcctaagttctacagcgatcgtaaagggatgaagggctggaacctgttccagttgatgcaccgtaaagcgcgcggcgatgatgttggtaacagcacctttggtggcaagaattactgtgctgaatccaatggtaacgctgccgacacgctgatgctgtgtgcatcctgggtcgctcaggcggatctttcggaattctttaagaaatggaatccgggtgcaagtgcttaccagttgccgggagcaacggagatgagtttccagggcggtgtgagctcttcggcttacagcacgctggcgtcactcaagctgccgaaaccggaaaaagggccggaaaccattaacaaggttaccgagcataagatgtctgccgagtaa

SEQ ID NO: 2 - protein, 1526 aa, Escherichia coli
MSLALLMNKKFKYKKSLLAAILSATLLAGCDGGGSGSSSDTPSVDSGSGTLPEVKPDPTPTPEPTPEPTPDPEPTPDPTPDPEPTPEPEPEPVPTKTGYLTLGGSQRVTGATCNGESSDGFTFTPGNTVSCVVGSTTIATFNTQSEAARSLRAVDKVSFSLEDAQELANSENKKTNAISLVTSSDSCPADAEQLCLTFSSVVDRARFEKLYKQIDLATDNFSKLVNEEVENNAATDKAPSTHTSTVVPVTTEGTKPDLNASFVSANAEQFYQYQPTEIILSEGQLVDSLGNGVAGVDYYTNSGRGVTDENGKFSFSWGETISFGIDTFELGSVRGNKSTIALTELGDEVRGANIDQLIHRYSTTGQNNTRVVPDDVRKVFAEYPNVINEIINLSLSNGATLDEGDQNVVLPNEFIEQFKTGQAKEIDTAICAKTDGCNEARWFSLTTRNVNDGQIQGVINKLWGVDTNYQSVSKFHVFHDSTNFYGSTGNARGQAVVNISNSAFPILMARNDKNYWLAFGEKRAWDKNELAYITEAPSIVQPENVTRDTATFNLPFISLGQVGEGKLMVIGNPHYNSILRCPNGYSWGGGVNSKGECTLSGDSDDMKHFMQNVLRYLSNDIWQPNTKSIMTVGTNLENVYFKKAGQVLGNSAPFAFHEDFTGITVKQLTSYGDLNPEEIPLLILNGFEYVTQWSGDPYAVPLRADTSKPKLTQQDVTDLIAYLNKGGSVLIMENVMSNLKEESASSFVRLLDAAGLSMALNKSVVNNDPQGYPDRVRQRRATGIWVYERYPAADGAQPPYTIDPNTGEVTWKYQQDNKPDDKPKLEVASWQEEVEGKQVTRYAFIDEAEYTTEESLEAAKAKIFEKFPGLQECKDSTYHYEINCLERRPGTDVPVTGGMYVPRYTQLNLDADTAKAMVQAADLGTNIQRLYQHELYFRTKGSKGERLNSVDLERLYQNMSVWLWNDTKYRYEEGKEDELGFKTFTEFLNCYANDAYAGGTKCSADLKKSLVDNNMIYGDGSSKAGMMNPSYPLNYMEKPLTRLMLGRSWWDLNIKVDVEKYPGSVSAKGESVTENISLYSNPTKWFAGNMQSTGLWAPAQQDVTIKSSASVPVTVTVALADDLTGREKHEVALNRPPRVTKTYTLEANGEVTFKVPYGGLIYIKGDSKDDVSANFTFTGVVKAPFYKDGEWKNDLDSPAPLGELESASFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLNVPGATEVANNVLALYMQDRYLGKMNRVADDITVAPEYLDESNGQAWARGGAGDRLLMYAQLKEWAEENFDIKQWYPDGELPKFYSDRKGMKGWNLFQLMHRKARGDDVGNSTFGGKNYCAESNGNAADTLMLCASWVAQADLSEFFKKWNPGASAYQLPGATEMSFQGGVSSSAYSTLASLKLPKPEKGPETINKVTEHKMSAE

SEQ ID NO: 3 - protein, 1521 aa, Escherichia coli
MNKKFKYKKSLLAAILSATLLAGCDGGGSGSSSDTPPVDSGTGSLPEVKPDPTPNPEPTPEPTPDPEPTPEPTPDPEPTPEPEPEPVPTKTGYLTLGGSQRITGATCNGESSDGFTFTPGDKVTCVAGNNTTIATFDTQSEAARSLRAVEKVSFSLEDAQELAASDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAEYPNVINEIINLSLSNGEALSEGDQTFERTNEFLEQFESGQAKEIDTAICDSLGGCNSQRWFSLTARNVNEGQIQGVINKLWGVDKDYKSVTKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKAKIFEKFPGLKECKDPTYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESSASVPVTVTVALADDLTGREKHEVALNRPPKVTKTYELKANGEVKFTVPYGGLIYIKGNSPQNESAEFTFTGVVKAPFYKDGAWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKQWYPEGDLPKFYSDREGMKGWNLFQLMHRKARGDEVGKTKFGERNYCAESNGNAADKLMLCASWVAQTDLSEFFKKWNPGANAYQLPGASEMNFEGGVSQSAYETLAALNLPKPQQGPETINQVTEHKMSAE

SEQ ID NO: 4 - protein, 1521 aa, Escherichia coli
MNKKFKYKKSLLAAILSATLLAGCDGGGSGSSSDTPPVDSGTGSLPEVKPDPTPNPEPTPEPTPDPEPTPEPTPDPEPTPEPEPEPVPTKTGYLTLGGSQRITGATCNGESSDGFTFTPGDKVTCVAGNNTTIATFDTQSEAARSLRAVEKVSFSLEDAQELAASDDKKSNAVSLVTSSNSCPADTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAEYPNVINEIINLSLSNGEALSEGDQTFERTNEFLEQFESGQAKEIDTAICDSLGGCNSQRWFSLTARNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKAKIFEKFPGLKECKDPTYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESTASVAVTVTVALADDLTGREKHEVALNRPPKVTKTYELKANGEVKFTVPYGGLIYIKGNSPQNESAEFTFTGVVKAPFYKDGAWKNALNSPAPLGELESDAFVYTTPKKNLEASNYKGGQEQFAEELDTFASSMNDFYGRNDEDGKHRMFTYKNLTGHKHRFTNDVQISIGDAHSGYPVMNSSFSTNSTTLPTTPLNDWLIWHEAGHNAAETPLTVPGATEVANNVLALYMQDRYLGKMNRVADDITVAPEYLEESNNQAWARGGAGDRLLMYAQLKEWAEKNFDITKWYPEGNLPKFYSEREGMKGWNLFQLMHRKARGDEVGKTKFGERNYCAESNGNAADTLMLCASWVAQTDLSAFFKKWNPGANAYQLPGASEMNFEGGVSQSAYETLAALNLPKPQQGPETINKVTEYSMPAE

SEQ ID NO: 5 - protein, 1520 aa, Escherichia coli
MNKKFKYKKSLLAAILSATLLAGCDGGGSGSSSDTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWKPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSSVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFHGRDSEDGKHRMFTYKNLPGHKHRFTNDVQISIGDAHSGYPVMNSSFSPNSTTLPTTPLNDWLIWHEVGHNAAETPLTVPGATEVANNVLALYMQDRYLGKMNRVADDITVAPEYLEESNNQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLDLPKPEQGPETINQVTEHKMSAE

SEQ ID NO: 6 - protein, 1522 aa, Escherichia coli
MNKKFKYKKSLLAAILSATLLAGCDGGGSGSSSDTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPVTTPGTKPDLNASFVSANAEQFYQYQPSEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWTPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSCVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLKLPKPEQGPETINKVTEHKMSVE

SEQ ID NO: 7 - protein, 1520 aa, Escherichia coli
MNKKFKYKKSLLAAILSATLLAGCDGGGSGSSSDTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPVTTPGTKPDLNASFVSANAEQFYQYQPSEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNDLAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSSMTVGTNLDTVYFKKHGQVLGNSAPFAFHKDFTGITVKPMTSYGNLNPDEVPLLILNGFEYVTQWGSDPYSIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGSGVPVTGGMYVPQYTQLDLGADTAKAMLQAADLGTNIQRLYQHELYFRTNGRQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDSESGKHRMFTYKNLTGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPEGELPKFFSDREGMKGWNLFQLMHRKARGDDVGNKTFGGKNYCAESNGNAADSLMLCASWVAQTDLSAFFKKWNPGANAYQLPGATEMSFEGGVSQSAYSTLASLKLPKPEQGPETINKVTEHKMSLE

SEQ ID NO: 8 - protein, 1521 aa, Escherichia coli
MNKKFKYKKSLLAAILSATLLAGCDGGGSGSSSDTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPVTTPGTKPDLNASFVSANAEQFYQYQPSEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWTPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSSVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDETSGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPEGELPKFFSDREGMKGWNLFQLMHRKARGDDVGDKTFGGKNYCAESNGNAADTLMLCASWVAQTDLSAFFKKWNPGANAYQLPGATEMSFEGGVSQSAYSTLASLKLPKPEQGPETINKVTEHKMSLE

SEQ ID NO: 9 - protein, 1521 aa, Escherichia coli
MNKKFKYKKSLLAAILSATLLAGCDGGGSGSSSDTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPATTPGTKPDLNASFVSANAEQFYQYQPTEIILSEGRLVDSQGDGVVGVNYYTNSGRGVTGENGEFSFSWGETISFGIDTFELGSVRGNKSTIALTELGDEVRGANIDQLIHRYSKAGQNHTRVVPDEVRKVFAEYPNVINEIINLSLSNGATLGEGEQVVNLPNEFIEQFKTGQAKEIDTAICAKTDGCNEARWFSLTTRNVNDGKIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSDDKWTPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGTDVPVTGGMYVPQYTQLDLSADTAKAMLQAADLGTNIQRLYQHELYFRTNGRQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGVVNTNGETVTQNINLYSAPTKWFAGNMQSTGLWAPAQQEVSIESKATVPVTVTVALADDLTGREKHEVSLNRPPRVTKTYDLKANDKVTFKVPYGGLIYIKGDSKEVQSADFTFTGVVKAPFYKDGKWQHDLNSPAPLGELESASFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLKLPKPEQGPETINKVTEHKMSVE

SEQ ID NO: 10 - protein, 1520 aa, Escherichia coli
MNKKFKYKKSLLAAILSATLLAGCDGGGSGSSSDTPSVDSGSGTLPEVKPDPTPTPEPTPEPTPDPEPTPDPTPDPDPEPTPEPEPEPVPTKTGYLTLGGSQRVTGATCNGESSDGFTFTPGNTVSCVVGSTTIATFNTQSEAARSLRAVDKVSFSLEDAQELANSENKKTNAISLVTSSDSCPADAEQLCLTFSSVVDRARFEKLYKQIDLATDNFSKLVNEEVENNAATDKAPSTHTSTVVPVTTEGTKPDLNASFVSANAEQFYQYQPTEIILSEGQLVDSLGNGVAGVDYYTNSGRGVTDENGKFSFSWGETISFGIDTFELGSVRGNKSTIALTELGDEVRGANIDQLIHRYSTTGQNNTRVVPDDVRKVFAEYPNVINEIINLSLSNGATLDEGDQNVVLPNEFIEQFKTGQAKEIDTAICAKTNGCNEARWFSLTTRNVNDGQIQGVINKLWGVDTNYQSVSKFHVFHDSTNFYGSTGNARGQAVVNISNAAFPILMARNDKNYWLAFGEKRAWDKNELAYITEAPSIVQPENVTRDTATFNLPFISLGQVGDGKLMVIGNPHYNSILRCPNGYSWGGGVNSKGECTLSGDSDDMKHFMQNVLRYLSNDIWQPNTKSIMTVGTNLENVYFKKAGQVLGNSAPFAFHEDFTGITVKQLTSYGDLNPEEIPLLILNGFEYVTQWSGDPYAVPLRADTSKPKLTQQDVTDLIAYLNKGGSVLIMENVMSNLKEESASSFVRLLDAAGLSMALNKSVVNNDPQGYPDRVRQQREKGIWVYERYPFVDGKPPYTIDETTKEVIWKYQQDNKPDDKPKLEVASWLEDVDGKQVKRYAFIDEAEHETNESLEAAKAKIIKAFPGLEECKDPTYHYEVNCLEYRPGTNVPVTGGMYVPRYTQLNLSADTAKAMVQAADLGTNIQRLYQHELYFRTNGRKGERLSSVDLERLYQNMSVWLWNEIEYSYDSSKEDELGFKTFTEFLNCYANDAYTKGTLCSAELKQSLIDNKMIYGEGSKAGMMNPSYPLNYMEKPLTRLMLGRSWWDLNIKVDVEKYPGAVSVGGEEVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESASFVYTTPKKNLNASNYTGGLDQFAKDLDTFASSMNDFYGRNDEDGKHRMFTYKNLTGHKHRFTNDVQISIGDAHSGYPVMNSSFSTNSTTLPTTPLNDWLIWHEVGHNAAETPLNVPGATEVANNVLALYMQDRYLGKMNRVADDITVAPEYLDESNGQAWARGGAGDRLLMYAQLKEWAEKNFDITKWYPDGKLPAFYSEREGMKGWNLFQLMHRKARGDDVGNSTFGGKNYCAESNGNAADTLMLCASWVAQTDLSEFFKKWNPGANAYQLPGAAEMSFEGGVSSSAYSTLASLNLPKPEKGPETINKVTEHKMSAE

SEQ ID NO: 11 - protein, 1519 aa, Escherichia coli
MNKKFKYKKSLLAAILSATLLAGCDGGGSGSSSDTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGEAISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETASFNLPFISLGQVGDGKLMVIGNPHYNSILRCPNGYSWNGGVNKDGQCTLNSDPDDMKNFMENVLRYLSNDRWLPDAKSSMTVGTNLETVYFKKHGQVLGNSAPFAFHKDFTGITVKPMTSYGNLNPDEVPLLILNGFEYVTQWGSDPYSIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGTDVPVTGGMYVPQYTQLDLSADTAKAMLQAADLGTNIQRLYQHELYFRTNGRQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGVVNTNGETVTQNINLYSAPTKWFAGNMQSTGLWAPAQQEVSIESKSTVPVTVTVALADDLTGREKHEVSLNRPPRVTKTYDLKANDKVTFKVPYGGLIYIKGDSKEVQSADFTFTGVVKAPFYKDGKWQHDLNSPAPLGELESASFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLDLPKPEQGPETINQVTEHKMSAE

SEQ ID NO: 12 - protein, 1523 aa, Escherichia coli
MNKKFKYKKSLLAAILSATLLAGCDGGGSGSSSDTPPVDSGTGSLPEVKPDPTPNPEPTPEPTPDPEPTPEPTPDPEPTPEPEPEPVPTKTGYLTLGGSQRITGATCNGESSDGFTFTPGDKVTCVAGNNTTIATFDTQSEAARSLRAVEKVSFSLEDAQELAASDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAAYPNVINEIINLSLSNGEALSEGDQTFERTNEFLEQFESGQAKEIDTAICDSLGGCNSQRWFSLTARNVNEGQIQGVINKLWGVDKDYKSVTKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSNDKWTPDAKASMTVGTNLDTVYFKRHGQVTGNSAEFGFHPDFAGISVEHLSSYGDLDPQKMPLLILNGFEYVTQVGGDPYAVPLRADTSKPKLSQQDVTDLIAYLNKGGSVLIMENVMSNLKEESASGFVRLLDAAGLSMALNKSVVNNDPQGYPDRVRQRRATGIWVYERYPVVEGELPYTIDSKTGKVTWKYQIDNKPDKKPKLEVASWQEEVDGKQVTQFAFIDEADHKTTESLDAAKKKILEKFKGLEECKDSTYHYEINCLEYRPGTNVPATGGMYVPRYTQLNLSADTAKAMVQAADLGTNIQRLYQHELYFRTNGRKGERLSSVDLERLYQNMSVWLWNEIEYSYDSSKEDELGFKTFTEFLNCYANDAYTGGTQCSDELKKSLVDNNMIYGEKSVNKAGMMNPSYPLNYMEKPLTRLMLGRSWWDLNIKVDVEKYPGAVSEEGQEVTESISLYSNPTKWFAGNMQSTGLWAPAQKEVTIKSNADVPVTVTVALADDLTGREKHEVALNRPPKVTKTYELKANGEVKFTVPYGGLIYIKGNSKENNKSASFTFTGVVKAPFYKNGAWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNNQAWARGGAGDRLLMYAQLKEWAEKNFDIKKWYPDGTPLPEFYSEREGMKGWNLFQLMHRKARGDEVSNDKFGGRNYCAESNGNTADTLMLCASWVAQTDLSEFFKKWNPGANAYQLPGATEMSFEGGVSQSAYNTLASLDLPKPKQGPETINKVTEYSMPAE

SEQ ID NO: 13 - protein, 1518 aa, Escherichia coli
MNKKFKYKKSLLAAILSATLLAGCDGGGSGSSSDTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSNMTVGTNLDTVYFKKHGQVTGNSAAFGFHPDFAGISVEHLSSYGDLDPQEMPLLILNGFEYVTQVGNDPYAIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKKRILDAFPGLEECKDSDYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANNAYDGGTQCSAELKQSLIDNKMIYGEGSKAGMMNPSYPLNYMEKPLTRLMLGRSWWDLNIKVDVEKYPGAVSAEGEEVTETINLYSNPTKWFAGNMQSTGLWAPAQQEVSIKSNAKVPVTVTVALADDLTGREKHEVALNRPPRVTKTYSLDASGTVKFKVPYGGLIYIKSDSKEEKSANFTFTGVVKAPFYKDGKWKNDLKSPAPLGELESASFVYTTPKKNLEASNYKGGLKQFAEDLDTFASSMNDFYGRDGESGKHRMFTYEALTGHKHRFTNDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKQWYPEGSLPAFYSEREGMKGWNLFQLMHRKARGDDVGNDKFGNRNYCAESNGNAADTLMLCASWVAQTDLSAFFKKWNPGANAYQLPGATEMSFEGGVSQSAYNTLASLDLPKPKQGPETINKVTEYSMPAE

SEQ ID NO: 14 - protein, 1520 aa, Escherichia coli
MNKKFKYKKSLLAAILSATLLAGCDGGGSGSSSDTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWKPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSSVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDSEDGKHRMFTYKNLPGHKHRFTNDVQISIGDAHSGYPVMNSSFSPNSTTLPTTPLNDWLIWHEVGHNAAETPLTVPGATEVANNVLALYMQDRYLGKMNRVADDITVAPEYLEESNNQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLDLPKPEQGPETINQVTEHKMSAE

SEQ ID NO: 15 - protein, 1518 aa, Escherichia coli
MNKKFKYKKSLLAAILSATLLAGCDGGGSGSSSDTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPEDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSNMTVGTNLDTVYFKKHGQVTGNSAAFGFHPDFAGISVEHLSSYGDLDPQEMPLLILNGFEYVTQVGNDPYAIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKKRILDAFPGLEECKDSDYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANNAYDGGTQCSAELKQSLIDNKMIYGEGSKAGMMNPSYPLNYMEKPLTRLMLGRSWWDLNIKVDVEKYPGAVSAEGEEVTETINLYSNPTKWFAGNMQSTGLWAPAQQEVSIKSNAKVPVTVTVALADDLTGREKHEVALNRPPRVTKTYSLDASGTVKFKVPYGGLIYIKSDSKEEKSANFTFTGVVKAPFYKDGKWKNDLKSPAPLGELESASFVYTTPKKNLEASNYKGGLKQFAEDLDTFASSMNDFYGRDGESGKHRMFTYEALTGHKHRFTNDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKQWYPEGSLPAFYSEREGMKGWNLFQLMHRKARGDDVGNDKFGNRNYCAESNGNAADTLMLCASWVAQTDLSAFFKKWNPGANAYQLPGATEMSFEGGVSQSAYNTLASLDLPKPEQGPETINQVTEHKMSAE

SEQ ID NO: 16 - protein, 1524 aa, Escherichia coli
MNKKFKYKKSLLAAILSATLLAGCDGGGSGPSSDTPPVDSGTGSLPEVKPDPTPNPEPTPEPTPDPEPTPDPTPDPEPTPEPEPEPVPTKTGYLTLGGSQRITGATCNGESSDGFTFTPGDKVTCVAGNNTTIATFDTQSEAARSLRAVEKVSFSLEDAQELAASDDKKSNAVSLVTSSNSCPADTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGDQNVVLPNEFIEQFKTGQAKEIDTAICAKTDGCNEARWFSLTTRNVNDGQIQGVINKLWGVDKDYKSVTKFHVFHDSTNFYGSTGNARGQAVVNISNAAFPILMARNDKNYWLAFGEKRAWDKNELAYITEAPSIVQPENVTRDTATFNLPFISLGQVGEGKLMVIGNPHYNSILRCPNGYSWNGGVNKDGQCTLSGDSDDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNTDPQGYPNRVRQQREKGIWVYERYPAVDSAQPPYTIDPDTGKVTWKYQEEGKPDDKPKLEVASWQEDVDGKQVTRYAFIDEAEHSTEESLEAAKAKIFEKFPGLQECKDSTYHYEINCLERRPGTDVPVTGGMYVPRYTQLNLDADTAKAMVQAADLGTNIQRLYQHELYFRTNGRKGERLSSVDLERLYQNMSVWLWNKIEYRYENDKDDELGFKTFTEFLNCYANNAYSEGTQCSADLKKSLVDNNMIYGDGSSKAGMMNPSYPLNYMEKPLTRLMLGRSWWDLNIKVDVEKYPGAVSAEGEKVTETISLYSNPTKWFAGNMQSTGLWAPAQQEVTIESTASVPVTVTVALADDLTGREKHEVALNRPPKVTKTYDLKANDKVTFKVPYGGLIYIKGNSPKNESAEFTFTGVVKAPFYKDGEWKNALNSPAPLGELESDSFVYTAPKNNLNASNYSNYTDGVAEFAKELDTFASSMNDFYGRDGESGNHRMFTYKALTGHKHRFANDVQISIGDAHSGYPVMNSSFSTNSTTLPTTPLNDWLIWHEVGHNAAETPLNVPGATEVANNVLALYMQDRYLGKMNRVADDITVAPEYLDESNGQAWARGGAGDRLLMYAQLKEWAEENFDIKQWYPDGELPKFYSDRKGMKGWNLFQLMHRKARGDDVSNDKFGGRNYCAESNGNAADTLMLCASWVAQADLSEFFKKWNPGANAYQLPGASEMSFEGGVSQSAYNTLAAMHLSKPEKGPETINKVTEYSMPAE

SEQ ID NO: 17 - protein, 10 aa, Escherichia coli
LPEVKPDPTP

SEQ ID NO: 18 - protein, 15 aa, Escherichia coli
PEPTPEPTPDPEPTP

SEQ ID NO: 19 - protein, 23 aa, Escherichia coli
EPTPEPEPEPVPTKTGYLTLGGS

SEQ ID NO: 20 - protein, 8 aa, Escherichia coli
ESSDGFTF

SEQ ID NO: 21 - protein, 12 aa, Escherichia coli
TQSEAARSLRAV

SEQ ID NO: 22 - protein, 12 aa, Escherichia coli
KVSFSLEDAQEL

SEQ ID NO: 23 - protein, 8 aa, Escherichia coli
LYKQIDLA

SEQ ID NO: 24 - protein, 22 aa, Escherichia coli
KLVNEEVENNAATDKAPSTHTS

SEQ ID NO: 25 - protein, 23 aa, Escherichia coli
GTKPDLNASFVSANAEQFYQYQP

SEQ ID NO: 26 - protein, 7 aa, Escherichia coli
EIILSEG

SEQ ID NO: 27 - protein, 42 aa, Escherichia coli
ISFGIDTFELGSVRGNKSTIALTELGDEVRGANIDQLIHRYS

SEQ ID NO: 28 - protein, 6 aa, Escherichia coli
VRKVFA

SEQ ID NO: 29 - protein, 16 aa, Escherichia coli
YPNVINEIINLSLSNG

SEQ ID NO: 30 - protein, 11 aa, Escherichia coli
GQAKEIDTAIC

SEQ ID NO: 31 - protein, 6 aa, Escherichia coli
RWFSLT

SEQ ID NO: 32 - protein, 12 aa, Escherichia coli
IQGVINKLWGVD

SEQ ID NO: 33 - protein, 28 aa, Escherichia coli
KFHVFHDSTNFYGSTGNARGQAVVNISN

SEQ ID NO: 34 - protein, 26 aa, Escherichia coli
AFPILMARNDKNYWLAFGEKRAWDKN

SEQ ID NO: 35 - protein, 9 aa, Escherichia coli
LAYITEAPS

SEQ ID NO: 36 - protein, 6 aa, Escherichia coli
PENVTR

SEQ ID NO: 37 - protein, 12 aa, Escherichia coli
FNLPFISLGQVG

SEQ ID NO: 38 - protein, 23 aa, Escherichia coli
GKLMVIGNPHYNSILRCPNGYSW

SEQ ID NO: 39 - protein, 7 aa, Escherichia coli
NVLRYLS

SEQ ID NO: 40 - protein, 7 aa, Escherichia coli
MTVGTNL

SEQ ID NO: 41 - protein, 13 aa, Escherichia coli
PLLILNGFEYVTQ

SEQ ID NO: 42 - protein, 11 aa, Escherichia coli
PLRADTSKPKL

SEQ ID NO: 43 - protein, 10 aa, Escherichia coli
QQDVTDLIAY

SEQ ID NO: 44 - protein, 22 aa, Escherichia coli
NKGGSVLIMENVMSNLKEESAS

SEQ ID NO: 45 - protein, 27 aa, Escherichia coli
FVRLLDAAGLSMALNKSVVNNDPQGYP

SEQ ID NO: 46 - protein, 8 aa, Escherichia coli
IWVYERYP

SEQ ID NO: 47 - protein, 8 aa, Escherichia coli
KPKLEVAS

SEQ ID NO: 48 - protein, 6 aa, Escherichia coli
AFIDEA

SEQ ID NO: 49 - protein, 9 aa, Escherichia coli
YHYEVNCLE

SEQ ID NO: 50 - protein, 7 aa, Escherichia coli
TGGMYVP

SEQ ID NO: 51 - protein, 7 aa, Escherichia coli
ADTAKAM

SEQ ID NO: 52 - protein, 21 aa, Escherichia coli
QAADLGTNIQRLYQHELYFRT

SEQ ID NO: 53 - protein, 16 aa, Escherichia coli
VDLERLYQNMSVWLWN

SEQ ID NO: 54 - protein, 15 aa, Escherichia coli
DELGFKTFTEFLNCY

SEQ ID NO: 55 - protein, 41 aa, Escherichia coli
KAGMMNPSYPLNYMEKPLTRLMLGRSWWDLNIKVDVEKYPG

SEQ ID NO: 56 - protein, 19 aa, Escherichia coli
PTKWFAGNMQSTGLWAPAQ

SEQ ID NO: 57 - protein, 19 aa, Escherichia coli
VTVTVALADDLTGREKHEV

SEQ ID NO: 58 - protein, 10 aa, Escherichia coli
VPYGGLIYIK

SEQ ID NO: 59 - protein, 13 aa, Escherichia coli
FTFTGVVKAPFYK

SEQ ID NO: 60 - protein, 10 aa, Escherichia coli
SPAPLGELES

SEQ ID NO: 61 - protein, 10 aa, Escherichia coli
FVYTTPKKNL

SEQ ID NO: 62 - protein, 11 aa, Escherichia coli
LDTFASSMNDF

SEQ ID NO: 63 - protein, 8 aa, Escherichia coli
GKHRMFTY

SEQ ID NO: 64 - protein, 6 aa, Escherichia coli
GHKHRF

SEQ ID NO: 65 - protein, 22 aa, Escherichia coli
NDVQISIGDAHSGYPVMNSSFS

SEQ ID NO: 66 - protein, 18 aa, Escherichia coli
NSTTLPTTPLNDWLIWHE

SEQ ID NO: 67 - protein, 9 aa, Escherichia coli
GHNAAETPL

SEQ ID NO: 68 - protein, 38 aa, Escherichia coli
VPGATEVANNVLALYMQDRYLGKMNRVADDITVAPEYL

SEQ ID NO: 69 - protein, 23 aa, Escherichia coli
QAWARGGAGDRLLMYAQLKEWAE

SEQ ID NO: 70 - protein, 18 aa, Escherichia coli
GMKGWNLFQLMHRKARGD

SEQ ID NO: 71 - protein, 9 aa, Escherichia coli
NYCAESNGN

SEQ ID NO: 72 - protein, 10 aa, Escherichia coli
LMLCASWVAQ

SEQ ID NO: 73 - protein, 9 aa, Escherichia coli
FFKKWNPGA

SEQ ID NO: 74 - protein, 7 aa, Escherichia coli
AYQLPGA

SEQ ID NO: 75 - protein, 76 aa, Escherichia coli
MNKKFKYKKSLLAAILSATLLAGCDGGGSGSSSDTPPVDSGTGSLPEVKPDPTPNPEPTPEPTPDPEPTPDPTPDP

SEQ ID NO: 76 - protein, 99 aa, Escherichia coli
MNKKFKYKKSLLAAILSATLLAGCDGGGSGSSSDTPPVDSGTGSLPEVKPDPTPNPEPTPEPTPDPEPTPDPTPDPEPTPEPEPEPVPTKTGYLTLGGS

SEQ ID NO: 77 - protein, 53 aa, Escherichia coli
CDGGGSGSSSDTPPVDSGTGSLPEVKPDPTPNPEPTPEPTPDPEPTPDPTPDP

SEQ ID NO: 78 - protein, 76 aa, Escherichia coli
CDGGGSGSSSDTPPVDSGTGSLPEVKPDPTPNPEPTPEPTPDPEPTPDPTPDPEPTPEPEPEPVPTKTGYLTLGGS

SEQ ID NO: 79 - protein, 76 aa, Escherichia coli
  VARIANT 37: Xaa = Ser or Pro
  VARIANT 42: Xaa = Ser or Thr
  VARIANT 44: Xaa = Ser or Thr
  VARIANT 55: Xaa = Asn or Thr
  VARIANT 71: Xaa = Asp  or Glu
  VARIANT 73: Xaa = Thr or Ile
MNKKFKYKKSLLAAILSATLLAGCDGGGSGSSSDTPXVDSGXGXLPEVKPDPTPXPEPTPEPTPDPEPTPXPXPDP

SEQ ID NO: 80 - protein, 28 aa, Escherichia coli
  VARIANT 24: Xaa = Gln or Leu
  VARIANT 26: Xaa = Val or Ile
EPTPEPEPEPVPTKTGYLTLGGSXRXTG

SEQ ID NO: 81 - protein, 15 aa, Escherichia coli
  VARIANT 4: Xaa = Gly or Asp
  VARIANT 13: Xaa = Thr or Lys
TCNXESSDGFTFXPG

SEQ ID NO: 82 - protein, 34 aa, Escherichia coli
  VARIANT 1: Xaa = Ser or Asn
  VARIANT 8: Xaa = Asn or Asp
  VARIANT 21: Xaa = Asp or Glu
XTTIATFXTQSEAARSLRAVXKVSFSLEDAQELA

SEQ ID NO: 83 - protein, 23 aa, Escherichia coli
  VARIANT 6: Xaa = Ser or Met
  VARIANT 7: Xaa = Asp or Asn
  VARIANT 12: Xaa = Asp or Asn
  VARIANT 13: Xaa = Ala or Thr
  VARIANT 16: Xaa = Leu or Val
  VARIANT 19: Xaa = Thr or Glu
SLVTSXXSCPAXXEQXCLXFSSV

SEQ ID NO: 84 - protein, 79 aa, Escherichia coli
  VARIANT 9: Xaa = Thr or Pro
  VARIANT 10: Xaa = Asp or Glu
  VARIANT 11: Xaa = Asn or Glu
  VARIANT 13: Xaa = Ser or Lys
  VARIANT 36: Xaa = Thr or Pro
  VARIANT 40: Xaa = Val or Ala
  VARIANT 43: Xaa = Glu or Pro
  VARIANT 67: Xaa = Thr or Ser
  VARIANT 75: Xaa = Gln or Arg
LYKQIDLAXXXFXKLVNEEVENNAATDKAPSTHTSXVVPXTTXGTKPDLNASFVSANAEQFYQYQPXEIILSEGXLVDS

SEQ ID NO: 85 - protein, 61 aa, Escherichia coli
  VARIANT 7: Xaa = Asp or Gly
  VARIANT 11: Xaa = Lys or Glu
  VARIANT 13: Xaa = Ser or Asn
  VARIANT 19: Xaa = Thr or Ala
SGRGVTXENGXFXFSWGEXISFGIDTFELGSVRGNKSTIALTELGDEVRGANIDQLIHRYS

SEQ ID NO: 86 - protein, 23 aa, Escherichia coli
  VARIANT 7: Xaa = Ala or Glu
VRKVFAXYPNVINEIINLSLSNG

SEQ ID NO: 87 - protein, 11 aa, Escherichia coli
  VARIANT 7: Xaa = Thr or Ala
RWFSLTXRNVN

SEQ ID NO: 88 - protein, 67 aa, Escherichia coli
  VARIANT 29: Xaa = Ala or Ser
  VARIANT 56: Xaa = Asp or Glu
KFHVFHDSTNFYGSTGNARGQAVVNISNXAFPILMARNDKNYWLAFGEKRAWDKNXLAYITEAPSIV

SEQ ID NO: 89 - protein, 36 aa, Escherichia coli
  VARIANT 13: Xaa = Asp or Glu
FNLPFISLGQVGXGKLMVIGNPHYNSILRCPNGYSW

SEQ ID NO: 90 - protein, 13 aa, Escherichia coli
  VARIANT 8: Xaa = Asp or Glu
MTVGTNLXNVYFK

SEQ ID NO: 91 - protein, 72 aa, Escherichia coli
  VARIANT 12: Xaa = Ser or Thr
  VARIANT 23: Xaa = Leu or Met
  VARIANT 46: Xaa = Gly or Ser
PLRADTSKPKLXQQDVTDLIAYXNKGGSVLIMENVMSNLKEESASXFVRLLDAAGLSMALNKSVVNNDPQGY

SEQ ID NO: 92 - protein, 29 aa, Escherichia coli
  VARIANT 8: Xaa = Val or Leu
ADTAKAMXQAADLGTNIQRLYQHELYFRT

SEQ ID NO: 93 - protein, 15 aa, Escherichia coli
DLDTFASSMNDFYGR

SEQ ID NO: 94 - protein, 17 aa, Escherichia coli
FFKKWNPGANAYQLPGA

SEQ ID NO: 95 - protein, 36 aa, Escherichia coli
MNKKFKYKKSLLAAILSATLLAGCDGGGSGSSSDTP

SEQ ID NO: 96 - protein, 26 aa, Escherichia coli
ICICICICICICICICICICICICIC

SEQ ID NO: 97 - protein, 11 aa, Escherichia coli
KLKLLLLLKLK

SEQ ID NO: 98 - protein, 7 aa, Escherichia coli
MSLALLM

SEQ ID NO: 99 - protein, 1487 aa, Escherichia coli
DTPSVDSGSGTLPEVKPDPTPTPEPTPEPTPDPEPTPDPTPDPEPTPEPEPEPVPTKTGYLTLGGSQRVTGATCNGESSDGFTFTPGNTVSCVVGSTTIATFNTQSEAARSLRAVDKVSFSLEDAQELANSENKKTNAISLVTSSDSCPADAEQLCLTFSSVVDRARFEKLYKQIDLATDNFSKLVNEEVENNAATDKAPSTHTSTVVPVTTEGTKPDLNASFVSANAEQFYQYQPTEIILSEGQLVDSLGNGVAGVDYYTNSGRGVTDENGKFSFSWGETISFGIDTFELGSVRGNKSTIALTELGDEVRGANIDQLIHRYSTTGQNNTRVVPDDVRKVFAEYPNVINEIINLSLSNGATLDEGDQNVVLPNEFIEQFKTGQAKEIDTAICAKTDGCNEARWFSLTTRNVNDGQIQGVINKLWGVDTNYQSVSKFHVFHDSTNFYGSTGNARGQAVVNISNSAFPILMARNDKNYWLAFGEKRAWDKNELAYITEAPSIVQPENVTRDTATFNLPFISLGQVGEGKLMVIGNPHYNSILRCPNGYSWGGGVNSKGECTLSGDSDDMKHFMQNVLRYLSNDIWQPNTKSIMTVGTNLENVYFKKAGQVLGNSAPFAFHEDFTGITVKQLTSYGDLNPEEIPLLILNGFEYVTQWSGDPYAVPLRADTSKPKLTQQDVTDLIAYLNKGGSVLIMENVMSNLKEESASSFVRLLDAAGLSMALNKSVVNNDPQGYPDRVRQRRATGIWVYERYPAADGAQPPYTIDPNTGEVTWKYQQDNKPDDKPKLEVASWQEEVEGKQVTRYAFIDEAEYTTEESLEAAKAKIFEKFPGLQECKDSTYHYEINCLERRPGTDVPVTGGMYVPRYTQLNLDADTAKAMVQAADLGTNIQRLYQHELYFRTKGSKGERLNSVDLERLYQNMSVWLWNDTKYRYEEGKEDELGFKTFTEFLNCYANDAYAGGTKCSADLKKSLVDNNMIYGDGSSKAGMMNPSYPLNYMEKPLTRLMLGRSWWDLNIKVDVEKYPGSVSAKGESVTENISLYSNPTKWFAGNMQSTGLWAPAQQDVTIKSSASVPVTVTVALADDLTGREKHEVALNRPPRVTKTYTLEANGEVTFKVPYGGLIYIKGDSKDDVSANFTFTGVVKAPFYKDGEWKNDLDSPAPLGELESASFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLNVPGATEVANNVLALYMQDRYLGKMNRVADDITVAPEYLDESNGQAWARGGAGDRLLMYAQLKEWAEENFDIKQWYPDGELPKFYSDRKGMKGWNLFQLMHRKARGDDVGNSTFGGKNYCAESNGNAADTLMLCASWVAQADLSEFFKKWNPGASAYQLPGATEMSFQGGVSSSAYSTLASLKLPKPEKGPETINKVTEHKMSAE

SEQ ID NO: 100 - protein, 1488 aa, Escherichia coli
DTPPVDSGTGSLPEVKPDPTPNPEPTPEPTPDPEPTPEPTPDPEPTPEPEPEPVPTKTGYLTLGGSQRITGATCNGESSDGFTFTPGDKVTCVAGNNTTIATFDTQSEAARSLRAVEKVSFSLEDAQELAASDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAEYPNVINEIINLSLSNGEALSEGDQTFERTNEFLEQFESGQAKEIDTAICDSLGGCNSQRWFSLTARNVNEGQIQGVINKLWGVDKDYKSVTKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKAKIFEKFPGLKECKDPTYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESSASVPVTVTVALADDLTGREKHEVALNRPPKVTKTYELKANGEVKFTVPYGGLIYIKGNSPQNESAEFTFTGVVKAPFYKDGAWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKQWYPEGDLPKFYSDREGMKGWNLFQLMHRKARGDEVGKTKFGERNYCAESNGNAADKLMLCASWVAQTDLSEFFKKWNPGANAYQLPGASEMNFEGGVSQSAYETLAALNLPKPQQGPETINQVTEHKMSAE

SEQ ID NO: 101 - protein, 1488 aa, Escherichia coli
DTPPVDSGTGSLPEVKPDPTPNPEPTPEPTPDPEPTPEPTPDPEPTPEPEPEPVPTKTGYLTLGGSQRITGATCNGESSDGFTFTPGDKVTCVAGNNTTIATFDTQSEAARSLRAVEKVSFSLEDAQELAASDDKKSNAVSLVTSSNSCPADTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAEYPNVINEIINLSLSNGEALSEGDQTFERTNEFLEQFESGQAKEIDTAICDSLGGCNSQRWFSLTARNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKAKIFEKFPGLKECKDPTYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESTASVAVTVTVALADDLTGREKHEVALNRPPKVTKTYELKANGEVKFTVPYGGLIYIKGNSPQNESAEFTFTGVVKAPFYKDGAWKNALNSPAPLGELESDAFVYTTPKKNLEASNYKGGQEQFAEELDTFASSMNDFYGRNDEDGKHRMFTYKNLTGHKHRFTNDVQISIGDAHSGYPVMNSSFSTNSTTLPTTPLNDWLIWHEAGHNAAETPLTVPGATEVANNVLALYMQDRYLGKMNRVADDITVAPEYLEESNNQAWARGGAGDRLLMYAQLKEWAEKNFDITKWYPEGNLPKFYSEREGMKGWNLFQLMHRKARGDEVGKTKFGERNYCAESNGNAADTLMLCASWVAQTDLSAFFKKWNPGANAYQLPGASEMNFEGGVSQSAYETLAALNLPKPQQGPETINKVTEYSMPAE

SEQ ID NO: 102 - protein, 1487 aa, Escherichia coli
DTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWKPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSSVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFHGRDSEDGKHRMFTYKNLPGHKHRFTNDVQISIGDAHSGYPVMNSSFSPNSTTLPTTPLNDWLIWHEVGHNAAETPLTVPGATEVANNVLALYMQDRYLGKMNRVADDITVAPEYLEESNNQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLDLPKPEQGPETINQVTEHKMSAE

SEQ ID NO: 103 - protein, 1489 aa, Escherichia coli
DTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPVTTPGTKPDLNASFVSANAEQFYQYQPSEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWTPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSCVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLKLPKPEQGPETINKVTEHKMSVE

SEQ ID NO: 104 - protein, 1487 aa, Escherichia coli
DTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPVTTPGTKPDLNASFVSANAEQFYQYQPSEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNDLAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSSMTVGTNLDTVYFKKHGQVLGNSAPFAFHKDFTGITVKPMTSYGNLNPDEVPLLILNGFEYVTQWGSDPYSIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGSGVPVTGGMYVPQYTQLDLGADTAKAMLQAADLGTNIQRLYQHELYFRTNGRQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDSESGKHRMFTYKNLTGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPEGELPKFFSDREGMKGWNLFQLMHRKARGDDVGNKTFGGKNYCAESNGNAADSLMLCASWVAQTDLSAFFKKWNPGANAYQLPGATEMSFEGGVSQSAYSTLASLKLPKPEQGPETINKVTEHKMSLE

SEQ ID NO: 105 - protein, 1488 aa, Escherichia coli
DTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPVTTPGTKPDLNASFVSANAEQFYQYQPSEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWTPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSSVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDETSGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPEGELPKFFSDREGMKGWNLFQLMHRKARGDDVGDKTFGGKNYCAESNGNAADTLMLCASWVAQTDLSAFFKKWNPGANAYQLPGATEMSFEGGVSQSAYSTLASLKLPKPEQGPETINKVTEHKMSLE

SEQ ID NO: 106 - protein, 1488 aa, Escherichia coli
DTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPATTPGTKPDLNASFVSANAEQFYQYQPTEIILSEGRLVDSQGDGVVGVNYYTNSGRGVTGENGEFSFSWGETISFGIDTFELGSVRGNKSTIALTELGDEVRGANIDQLIHRYSKAGQNHTRVVPDEVRKVFAEYPNVINEIINLSLSNGATLGEGEQVVNLPNEFIEQFKTGQAKEIDTAICAKTDGCNEARWFSLTTRNVNDGKIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSDDKWTPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGTDVPVTGGMYVPQYTQLDLSADTAKAMLQAADLGTNIQRLYQHELYFRTNGRQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGVVNTNGETVTQNINLYSAPTKWFAGNMQSTGLWAPAQQEVSIESKATVPVTVTVALADDLTGREKHEVSLNRPPRVTKTYDLKANDKVTFKVPYGGLIYIKGDSKEVQSADFTFTGVVKAPFYKDGKWQHDLNSPAPLGELESASFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLKLPKPEQGPETINKVTEHKMSVE

SEQ ID NO: 107 - protein, 1487 aa, Escherichia coli
DTPSVDSGSGTLPEVKPDPTPTPEPTPEPTPDPEPTPDPTPDPDPEPTPEPEPEPVPTKTGYLTLGGSQRVTGATCNGESSDGFTFTPGNTVSCVVGSTTIATFNTQSEAARSLRAVDKVSFSLEDAQELANSENKKTNAISLVTSSDSCPADAEQLCLTFSSVVDRARFEKLYKQIDLATDNFSKLVNEEVENNAATDKAPSTHTSTVVPVTTEGTKPDLNASFVSANAEQFYQYQPTEIILSEGQLVDSLGNGVAGVDYYTNSGRGVTDENGKFSFSWGETISFGIDTFELGSVRGNKSTIALTELGDEVRGANIDQLIHRYSTTGQNNTRVVPDDVRKVFAEYPNVINEIINLSLSNGATLDEGDQNVVLPNEFIEQFKTGQAKEIDTAICAKTNGCNEARWFSLTTRNVNDGQIQGVINKLWGVDTNYQSVSKFHVFHDSTNFYGSTGNARGQAVVNISNAAFPILMARNDKNYWLAFGEKRAWDKNELAYITEAPSIVQPENVTRDTATFNLPFISLGQVGDGKLMVIGNPHYNSILRCPNGYSWGGGVNSKGECTLSGDSDDMKHFMQNVLRYLSNDIWQPNTKSIMTVGTNLENVYFKKAGQVLGNSAPFAFHEDFTGITVKQLTSYGDLNPEEIPLLILNGFEYVTQWSGDPYAVPLRADTSKPKLTQQDVTDLIAYLNKGGSVLIMENVMSNLKEESASSFVRLLDAAGLSMALNKSVVNNDPQGYPDRVRQQREKGIWVYERYPFVDGKPPYTIDETTKEVIWKYQQDNKPDDKPKLEVASWLEDVDGKQVKRYAFIDEAEHETNESLEAAKAKIIKAFPGLEECKDPTYHYEVNCLEYRPGTNVPVTGGMYVPRYTQLNLSADTAKAMVQAADLGTNIQRLYQHELYFRTNGRKGERLSSVDLERLYQNMSVWLWNEIEYSYDSSKEDELGFKTFTEFLNCYANDAYTKGTLCSAELKQSLIDNKMIYGEGSKAGMMNPSYPLNYMEKPLTRLMLGRSWWDLNIKVDVEKYPGAVSVGGEEVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESASFVYTTPKKNLNASNYTGGLDQFAKDLDTFASSMNDFYGRNDEDGKHRMFTYKNLTGHKHRFTNDVQISIGDAHSGYPVMNSSFSTNSTTLPTTPLNDWLIWHEVGHNAAETPLNVPGATEVANNVLALYMQDRYLGKMNRVADDITVAPEYLDESNGQAWARGGAGDRLLMYAQLKEWAEKNFDITKWYPDGKLPAFYSEREGMKGWNLFQLMHRKARGDDVGNSTFGGKNYCAESNGNAADTLMLCASWVAQTDLSEFFKKWNPGANAYQLPGAAEMSFEGGVSSSAYSTLASLNLPKPEKGPETINKVTEHKMSAE

SEQ ID NO: 108 - protein, 1486 aa, Escherichia coli
DTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGEAISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETASFNLPFISLGQVGDGKLMVIGNPHYNSILRCPNGYSWNGGVNKDGQCTLNSDPDDMKNFMENVLRYLSNDRWLPDAKSSMTVGTNLETVYFKKHGQVLGNSAPFAFHKDFTGITVKPMTSYGNLNPDEVPLLILNGFEYVTQWGSDPYSIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGTDVPVTGGMYVPQYTQLDLSADTAKAMLQAADLGTNIQRLYQHELYFRTNGRQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGVVNTNGETVTQNINLYSAPTKWFAGNMQSTGLWAPAQQEVSIESKSTVPVTVTVALADDLTGREKHEVSLNRPPRVTKTYDLKANDKVTFKVPYGGLIYIKGDSKEVQSADFTFTGVVKAPFYKDGKWQHDLNSPAPLGELESASFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLDLPKPEQGPETINQVTEHKMSAE

SEQ ID NO: 109 - protein, 1490 aa, Escherichia coli
DTPPVDSGTGSLPEVKPDPTPNPEPTPEPTPDPEPTPEPTPDPEPTPEPEPEPVPTKTGYLTLGGSQRITGATCNGESSDGFTFTPGDKVTCVAGNNTTIATFDTQSEAARSLRAVEKVSFSLEDAQELAASDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAAYPNVINEIINLSLSNGEALSEGDQTFERTNEFLEQFESGQAKEIDTAICDSLGGCNSQRWFSLTARNVNEGQIQGVINKLWGVDKDYKSVTKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSNDKWTPDAKASMTVGTNLDTVYFKRHGQVTGNSAEFGFHPDFAGISVEHLSSYGDLDPQKMPLLILNGFEYVTQVGGDPYAVPLRADTSKPKLSQQDVTDLIAYLNKGGSVLIMENVMSNLKEESASGFVRLLDAAGLSMALNKSVVNNDPQGYPDRVRQRRATGIWVYERYPVVEGELPYTIDSKTGKVTWKYQIDNKPDKKPKLEVASWQEEVDGKQVTQFAFIDEADHKTTESLDAAKKKILEKFKGLEECKDSTYHYEINCLEYRPGTNVPATGGMYVPRYTQLNLSADTAKAMVQAADLGTNIQRLYQHELYFRTNGRKGERLSSVDLERLYQNMSVWLWNEIEYSYDSSKEDELGFKTFTEFLNCYANDAYTGGTQCSDELKKSLVDNNMIYGEKSVNKAGMMNPSYPLNYMEKPLTRLMLGRSWWDLNIKVDVEKYPGAVSEEGQEVTESISLYSNPTKWFAGNMQSTGLWAPAQKEVTIKSNADVPVTVTVALADDLTGREKHEVALNRPPKVTKTYELKANGEVKFTVPYGGLIYIKGNSKENNKSASFTFTGVVKAPFYKNGAWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNNQAWARGGAGDRLLMYAQLKEWAEKNFDIKKWYPDGTPLPEFYSEREGMKGWNLFQLMHRKARGDEVSNDKFGGRNYCAESNGNTADTLMLCASWVAQTDLSEFFKKWNPGANAYQLPGATEMSFEGGVSQSAYNTLASLDLPKPKQGPETINKVTEYSMPAE

SEQ ID NO: 110 - protein, 1485 aa, Escherichia coli
DTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSNMTVGTNLDTVYFKKHGQVTGNSAAFGFHPDFAGISVEHLSSYGDLDPQEMPLLILNGFEYVTQVGNDPYAIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKKRILDAFPGLEECKDSDYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANNAYDGGTQCSAELKQSLIDNKMIYGEGSKAGMMNPSYPLNYMEKPLTRLMLGRSWWDLNIKVDVEKYPGAVSAEGEEVTETINLYSNPTKWFAGNMQSTGLWAPAQQEVSIKSNAKVPVTVTVALADDLTGREKHEVALNRPPRVTKTYSLDASGTVKFKVPYGGLIYIKSDSKEEKSANFTFTGVVKAPFYKDGKWKNDLKSPAPLGELESASFVYTTPKKNLEASNYKGGLKQFAEDLDTFASSMNDFYGRDGESGKHRMFTYEALTGHKHRFTNDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKQWYPEGSLPAFYSEREGMKGWNLFQLMHRKARGDDVGNDKFGNRNYCAESNGNAADTLMLCASWVAQTDLSAFFKKWNPGANAYQLPGATEMSFEGGVSQSAYNTLASLDLPKPKQGPETINKVTEYSMPAE

SEQ ID NO: 111 - protein, 1487 aa, Escherichia coli
DTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWKPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSSVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDSEDGKHRMFTYKNLPGHKHRFTNDVQISIGDAHSGYPVMNSSFSPNSTTLPTTPLNDWLIWHEVGHNAAETPLTVPGATEVANNVLALYMQDRYLGKMNRVADDITVAPEYLEESNNQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLDLPKPEQGPETINQVTEHKMSAE

SEQ ID NO: 112 - protein, 1485 aa, Escherichia coli
DTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPEDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSNMTVGTNLDTVYFKKHGQVTGNSAAFGFHPDFAGISVEHLSSYGDLDPQEMPLLILNGFEYVTQVGNDPYAIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKKRILDAFPGLEECKDSDYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANNAYDGGTQCSAELKQSLIDNKMIYGEGSKAGMMNPSYPLNYMEKPLTRLMLGRSWWDLNIKVDVEKYPGAVSAEGEEVTETINLYSNPTKWFAGNMQSTGLWAPAQQEVSIKSNAKVPVTVTVALADDLTGREKHEVALNRPPRVTKTYSLDASGTVKFKVPYGGLIYIKSDSKEEKSANFTFTGVVKAPFYKDGKWKNDLKSPAPLGELESASFVYTTPKKNLEASNYKGGLKQFAEDLDTFASSMNDFYGRDGESGKHRMFTYEALTGHKHRFTNDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKQWYPEGSLPAFYSEREGMKGWNLFQLMHRKARGDDVGNDKFGNRNYCAESNGNAADTLMLCASWVAQTDLSAFFKKWNPGANAYQLPGATEMSFEGGVSQSAYNTLASLDLPKPEQGPETINQVTEHKMSAE

SEQ ID NO: 113 - protein, 1491 aa, Escherichia coli
DTPPVDSGTGSLPEVKPDPTPNPEPTPEPTPDPEPTPDPTPDPEPTPEPEPEPVPTKTGYLTLGGSQRITGATCNGESSDGFTFTPGDKVTCVAGNNTTIATFDTQSEAARSLRAVEKVSFSLEDAQELAASDDKKSNAVSLVTSSNSCPADTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGDQNVVLPNEFIEQFKTGQAKEIDTAICAKTDGCNEARWFSLTTRNVNDGQIQGVINKLWGVDKDYKSVTKFHVFHDSTNFYGSTGNARGQAVVNISNAAFPILMARNDKNYWLAFGEKRAWDKNELAYITEAPSIVQPENVTRDTATFNLPFISLGQVGEGKLMVIGNPHYNSILRCPNGYSWNGGVNKDGQCTLSGDSDDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNTDPQGYPNRVRQQREKGIWVYERYPAVDSAQPPYTIDPDTGKVTWKYQEEGKPDDKPKLEVASWQEDVDGKQVTRYAFIDEAEHSTEESLEAAKAKIFEKFPGLQECKDSTYHYEINCLERRPGTDVPVTGGMYVPRYTQLNLDADTAKAMVQAADLGTNIQRLYQHELYFRTNGRKGERLSSVDLERLYQNMSVWLWNKIEYRYENDKDDELGFKTFTEFLNCYANNAYSEGTQCSADLKKSLVDNNMIYGDGSSKAGMMNPSYPLNYMEKPLTRLMLGRSWWDLNIKVDVEKYPGAVSAEGEKVTETISLYSNPTKWFAGNMQSTGLWAPAQQEVTIESTASVPVTVTVALADDLTGREKHEVALNRPPKVTKTYDLKANDKVTFKVPYGGLIYIKGNSPKNESAEFTFTGVVKAPFYKDGEWKNALNSPAPLGELESDSFVYTAPKNNLNASNYSNYTDGVAEFAKELDTFASSMNDFYGRDGESGNHRMFTYKALTGHKHRFANDVQISIGDAHSGYPVMNSSFSTNSTTLPTTPLNDWLIWHEVGHNAAETPLNVPGATEVANNVLALYMQDRYLGKMNRVADDITVAPEYLDESNGQAWARGGAGDRLLMYAQLKEWAEENFDIKQWYPDGELPKFYSDRKGMKGWNLFQLMHRKARGDDVSNDKFGGRNYCAESNGNAADTLMLCASWVAQADLSEFFKKWNPGANAYQLPGASEMSFEGGVSQSAYNTLAAMHLSKPEKGPETINKVTEYSMPAE

SEQ ID NO: 114 - protein, 1431 aa, Escherichia coli
KTGYLTLGGSQRVTGATCNGESSDGFTFTPGNTVSCVVGSTTIATFNTQSEAARSLRAVDKVSFSLEDAQELANSENKKTNAISLVTSSDSCPADAEQLCLTFSSVVDRARFEKLYKQIDLATDNFSKLVNEEVENNAATDKAPSTHTSTVVPVTTEGTKPDLNASFVSANAEQFYQYQPTEIILSEGQLVDSLGNGVAGVDYYTNSGRGVTDENGKFSFSWGETISFGIDTFELGSVRGNKSTIALTELGDEVRGANIDQLIHRYSTTGQNNTRVVPDDVRKVFAEYPNVINEIINLSLSNGATLDEGDQNVVLPNEFIEQFKTGQAKEIDTAICAKTDGCNEARWFSLTTRNVNDGQIQGVINKLWGVDTNYQSVSKFHVFHDSTNFYGSTGNARGQAVVNISNSAFPILMARNDKNYWLAFGEKRAWDKNELAYITEAPSIVQPENVTRDTATFNLPFISLGQVGEGKLMVIGNPHYNSILRCPNGYSWGGGVNSKGECTLSGDSDDMKHFMQNVLRYLSNDIWQPNTKSIMTVGTNLENVYFKKAGQVLGNSAPFAFHEDFTGITVKQLTSYGDLNPEEIPLLILNGFEYVTQWSGDPYAVPLRADTSKPKLTQQDVTDLIAYLNKGGSVLIMENVMSNLKEESASSFVRLLDAAGLSMALNKSVVNNDPQGYPDRVRQRRATGIWVYERYPAADGAQPPYTIDPNTGEVTWKYQQDNKPDDKPKLEVASWQEEVEGKQVTRYAFIDEAEYTTEESLEAAKAKIFEKFPGLQECKDSTYHYEINCLERRPGTDVPVTGGMYVPRYTQLNLDADTAKAMVQAADLGTNIQRLYQHELYFRTKGSKGERLNSVDLERLYQNMSVWLWNDTKYRYEEGKEDELGFKTFTEFLNCYANDAYAGGTKCSADLKKSLVDNNMIYGDGSSKAGMMNPSYPLNYMEKPLTRLMLGRSWWDLNIKVDVEKYPGSVSAKGESVTENISLYSNPTKWFAGNMQSTGLWAPAQQDVTIKSSASVPVTVTVALADDLTGREKHEVALNRPPRVTKTYTLEANGEVTFKVPYGGLIYIKGDSKDDVSANFTFTGVVKAPFYKDGEWKNDLDSPAPLGELESASFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLNVPGATEVANNVLALYMQDRYLGKMNRVADDITVAPEYLDESNGQAWARGGAGDRLLMYAQLKEWAEENFDIKQWYPDGELPKFYSDRKGMKGWNLFQLMHRKARGDDVGNSTFGGKNYCAESNGNAADTLMLCASWVAQADLSEFFKKWNPGASAYQLPGATEMSFQGGVSSSAYSTLASLKLPKPEKGPETINKVTEHKMSAE

SEQ ID NO: 115 - protein, 1432 aa, Escherichia coli
KTGYLTLGGSQRITGATCNGESSDGFTFTPGDKVTCVAGNNTTIATFDTQSEAARSLRAVEKVSFSLEDAQELAASDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAEYPNVINEIINLSLSNGEALSEGDQTFERTNEFLEQFESGQAKEIDTAICDSLGGCNSQRWFSLTARNVNEGQIQGVINKLWGVDKDYKSVTKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKAKIFEKFPGLKECKDPTYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESSASVPVTVTVALADDLTGREKHEVALNRPPKVTKTYELKANGEVKFTVPYGGLIYIKGNSPQNESAEFTFTGVVKAPFYKDGAWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKQWYPEGDLPKFYSDREGMKGWNLFQLMHRKARGDEVGKTKFGERNYCAESNGNAADKLMLCASWVAQTDLSEFFKKWNPGANAYQLPGASEMNFEGGVSQSAYETLAALNLPKPQQGPETINQVTEHKMSAE

SEQ ID NO: 116 - protein, 1432 aa, Escherichia coli
KTGYLTLGGSQRITGATCNGESSDGFTFTPGDKVTCVAGNNTTIATFDTQSEAARSLRAVEKVSFSLEDAQELAASDDKKSNAVSLVTSSNSCPADTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAEYPNVINEIINLSLSNGEALSEGDQTFERTNEFLEQFESGQAKEIDTAICDSLGGCNSQRWFSLTARNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKAKIFEKFPGLKECKDPTYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESTASVAVTVTVALADDLTGREKHEVALNRPPKVTKTYELKANGEVKFTVPYGGLIYIKGNSPQNESAEFTFTGVVKAPFYKDGAWKNALNSPAPLGELESDAFVYTTPKKNLEASNYKGGQEQFAEELDTFASSMNDFYGRNDEDGKHRMFTYKNLTGHKHRFTNDVQISIGDAHSGYPVMNSSFSTNSTTLPTTPLNDWLIWHEAGHNAAETPLTVPGATEVANNVLALYMQDRYLGKMNRVADDITVAPEYLEESNNQAWARGGAGDRLLMYAQLKEWAEKNFDITKWYPEGNLPKFYSEREGMKGWNLFQLMHRKARGDEVGKTKFGERNYCAESNGNAADTLMLCASWVAQTDLSAFFKKWNPGANAYQLPGASEMNFEGGVSQSAYETLAALNLPKPQQGPETINKVTEYSMPAE

SEQ ID NO: 117 - protein, 1431 aa, Escherichia coli
KTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWKPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSSVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFHGRDSEDGKHRMFTYKNLPGHKHRFTNDVQISIGDAHSGYPVMNSSFSPNSTTLPTTPLNDWLIWHEVGHNAAETPLTVPGATEVANNVLALYMQDRYLGKMNRVADDITVAPEYLEESNNQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLDLPKPEQGPETINQVTEHKMSAE

SEQ ID NO: 118 - protein, 1433 aa, Escherichia coli
KTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPVTTPGTKPDLNASFVSANAEQFYQYQPSEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWTPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSCVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLKLPKPEQGPETINKVTEHKMSVE

SEQ ID NO: 119 - protein, 1431 aa, Escherichia coli
KTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPVTTPGTKPDLNASFVSANAEQFYQYQPSEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNDLAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSSMTVGTNLDTVYFKKHGQVLGNSAPFAFHKDFTGITVKPMTSYGNLNPDEVPLLILNGFEYVTQWGSDPYSIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGSGVPVTGGMYVPQYTQLDLGADTAKAMLQAADLGTNIQRLYQHELYFRTNGRQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDSESGKHRMFTYKNLTGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPEGELPKFFSDREGMKGWNLFQLMHRKARGDDVGNKTFGGKNYCAESNGNAADSLMLCASWVAQTDLSAFFKKWNPGANAYQLPGATEMSFEGGVSQSAYSTLASLKLPKPEQGPETINKVTEHKMSLE

SEQ ID NO: 120 - protein, 1432 aa, Escherichia coli
KTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPVTTPGTKPDLNASFVSANAEQFYQYQPSEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWTPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSSVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDETSGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPEGELPKFFSDREGMKGWNLFQLMHRKARGDDVGDKTFGGKNYCAESNGNAADTLMLCASWVAQTDLSAFFKKWNPGANAYQLPGATEMSFEGGVSQSAYSTLASLKLPKPEQGPETINKVTEHKMSLE

SEQ ID NO: 121 - protein, 1432 aa, Escherichia coli
KTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPATTPGTKPDLNASFVSANAEQFYQYQPTEIILSEGRLVDSQGDGVVGVNYYTNSGRGVTGENGEFSFSWGETISFGIDTFELGSVRGNKSTIALTELGDEVRGANIDQLIHRYSKAGQNHTRVVPDEVRKVFAEYPNVINEIINLSLSNGATLGEGEQVVNLPNEFIEQFKTGQAKEIDTAICAKTDGCNEARWFSLTTRNVNDGKIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSDDKWTPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGTDVPVTGGMYVPQYTQLDLSADTAKAMLQAADLGTNIQRLYQHELYFRTNGRQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGVVNTNGETVTQNINLYSAPTKWFAGNMQSTGLWAPAQQEVSIESKATVPVTVTVALADDLTGREKHEVSLNRPPRVTKTYDLKANDKVTFKVPYGGLIYIKGDSKEVQSADFTFTGVVKAPFYKDGKWQHDLNSPAPLGELESASFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLKLPKPEQGPETINKVTEHKMSVE

SEQ ID NO: 122 - protein, 1429 aa, Escherichia coli
KTGYLTLGGSQRVTGATCNGESSDGFTFTPGNTVSCVVGSTTIATFNTQSEAARSLRAVDKVSFSLEDAQELANSENKKTNAISLVTSSDSCPADAEQLCLTFSSVVDRARFEKLYKQIDLATDNFSKLVNEEVENNAATDKAPSTHTSTVVPVTTEGTKPDLNASFVSANAEQFYQYQPTEIILSEGQLVDSLGNGVAGVDYYTNSGRGVTDENGKFSFSWGETISFGIDTFELGSVRGNKSTIALTELGDEVRGANIDQLIHRYSTTGQNNTRVVPDDVRKVFAEYPNVINEIINLSLSNGATLDEGDQNVVLPNEFIEQFKTGQAKEIDTAICAKTNGCNEARWFSLTTRNVNDGQIQGVINKLWGVDTNYQSVSKFHVFHDSTNFYGSTGNARGQAVVNISNAAFPILMARNDKNYWLAFGEKRAWDKNELAYITEAPSIVQPENVTRDTATFNLPFISLGQVGDGKLMVIGNPHYNSILRCPNGYSWGGGVNSKGECTLSGDSDDMKHFMQNVLRYLSNDIWQPNTKSIMTVGTNLENVYFKKAGQVLGNSAPFAFHEDFTGITVKQLTSYGDLNPEEIPLLILNGFEYVTQWSGDPYAVPLRADTSKPKLTQQDVTDLIAYLNKGGSVLIMENVMSNLKEESASSFVRLLDAAGLSMALNKSVVNNDPQGYPDRVRQQREKGIWVYERYPFVDGKPPYTIDETTKEVIWKYQQDNKPDDKPKLEVASWLEDVDGKQVKRYAFIDEAEHETNESLEAAKAKIIKAFPGLEECKDPTYHYEVNCLEYRPGTNVPVTGGMYVPRYTQLNLSADTAKAMVQAADLGTNIQRLYQHELYFRTNGRKGERLSSVDLERLYQNMSVWLWNEIEYSYDSSKEDELGFKTFTEFLNCYANDAYTKGTLCSAELKQSLIDNKMIYGEGSKAGMMNPSYPLNYMEKPLTRLMLGRSWWDLNIKVDVEKYPGAVSVGGEEVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESASFVYTTPKKNLNASNYTGGLDQFAKDLDTFASSMNDFYGRNDEDGKHRMFTYKNLTGHKHRFTNDVQISIGDAHSGYPVMNSSFSTNSTTLPTTPLNDWLIWHEVGHNAAETPLNVPGATEVANNVLALYMQDRYLGKMNRVADDITVAPEYLDESNGQAWARGGAGDRLLMYAQLKEWAEKNFDITKWYPDGKLPAFYSEREGMKGWNLFQLMHRKARGDDVGNSTFGGKNYCAESNGNAADTLMLCASWVAQTDLSEFFKKWNPGANAYQLPGAAEMSFEGGVSSSAYSTLASLNLPKPEKGPETINKVTEHKMSAE

SEQ ID NO: 123 - protein, 1430 aa, Escherichia coli
KTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGEAISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETASFNLPFISLGQVGDGKLMVIGNPHYNSILRCPNGYSWNGGVNKDGQCTLNSDPDDMKNFMENVLRYLSNDRWLPDAKSSMTVGTNLETVYFKKHGQVLGNSAPFAFHKDFTGITVKPMTSYGNLNPDEVPLLILNGFEYVTQWGSDPYSIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGTDVPVTGGMYVPQYTQLDLSADTAKAMLQAADLGTNIQRLYQHELYFRTNGRQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGVVNTNGETVTQNINLYSAPTKWFAGNMQSTGLWAPAQQEVSIESKSTVPVTVTVALADDLTGREKHEVSLNRPPRVTKTYDLKANDKVTFKVPYGGLIYIKGDSKEVQSADFTFTGVVKAPFYKDGKWQHDLNSPAPLGELESASFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLDLPKPEQGPETINQVTEHKMSAE

SEQ ID NO: 124 - protein, 1434 aa, Escherichia coli
KTGYLTLGGSQRITGATCNGESSDGFTFTPGDKVTCVAGNNTTIATFDTQSEAARSLRAVEKVSFSLEDAQELAASDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAAYPNVINEIINLSLSNGEALSEGDQTFERTNEFLEQFESGQAKEIDTAICDSLGGCNSQRWFSLTARNVNEGQIQGVINKLWGVDKDYKSVTKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSNDKWTPDAKASMTVGTNLDTVYFKRHGQVTGNSAEFGFHPDFAGISVEHLSSYGDLDPQKMPLLILNGFEYVTQVGGDPYAVPLRADTSKPKLSQQDVTDLIAYLNKGGSVLIMENVMSNLKEESASGFVRLLDAAGLSMALNKSVVNNDPQGYPDRVRQRRATGIWVYERYPVVEGELPYTIDSKTGKVTWKYQIDNKPDKKPKLEVASWQEEVDGKQVTQFAFIDEADHKTTESLDAAKKKILEKFKGLEECKDSTYHYEINCLEYRPGTNVPATGGMYVPRYTQLNLSADTAKAMVQAADLGTNIQRLYQHELYFRTNGRKGERLSSVDLERLYQNMSVWLWNEIEYSYDSSKEDELGFKTFTEFLNCYANDAYTGGTQCSDELKKSLVDNNMIYGEKSVNKAGMMNPSYPLNYMEKPLTRLMLGRSWWDLNIKVDVEKYPGAVSEEGQEVTESISLYSNPTKWFAGNMQSTGLWAPAQKEVTIKSNADVPVTVTVALADDLTGREKHEVALNRPPKVTKTYELKANGEVKFTVPYGGLIYIKGNSKENNKSASFTFTGVVKAPFYKNGAWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNNQAWARGGAGDRLLMYAQLKEWAEKNFDIKKWYPDGTPLPEFYSEREGMKGWNLFQLMHRKARGDEVSNDKFGGRNYCAESNGNTADTLMLCASWVAQTDLSEFFKKWNPGANAYQLPGATEMSFEGGVSQSAYNTLASLDLPKPKQGPETINKVTEYSMPAE

SEQ ID NO: 125 - protein, 1429 aa, Escherichia coli
KTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSNMTVGTNLDTVYFKKHGQVTGNSAAFGFHPDFAGISVEHLSSYGDLDPQEMPLLILNGFEYVTQVGNDPYAIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKKRILDAFPGLEECKDSDYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANNAYDGGTQCSAELKQSLIDNKMIYGEGSKAGMMNPSYPLNYMEKPLTRLMLGRSWWDLNIKVDVEKYPGAVSAEGEEVTETINLYSNPTKWFAGNMQSTGLWAPAQQEVSIKSNAKVPVTVTVALADDLTGREKHEVALNRPPRVTKTYSLDASGTVKFKVPYGGLIYIKSDSKEEKSANFTFTGVVKAPFYKDGKWKNDLKSPAPLGELESASFVYTTPKKNLEASNYKGGLKQFAEDLDTFASSMNDFYGRDGESGKHRMFTYEALTGHKHRFTNDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKQWYPEGSLPAFYSEREGMKGWNLFQLMHRKARGDDVGNDKFGNRNYCAESNGNAADTLMLCASWVAQTDLSAFFKKWNPGANAYQLPGATEMSFEGGVSQSAYNTLASLDLPKPKQGPETINKVTEYSMPAE

SEQ ID NO: 126 - protein, 1431 aa, Escherichia coli
KTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWKPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSSVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDSEDGKHRMFTYKNLPGHKHRFTNDVQISIGDAHSGYPVMNSSFSPNSTTLPTTPLNDWLIWHEVGHNAAETPLTVPGATEVANNVLALYMQDRYLGKMNRVADDITVAPEYLEESNNQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLDLPKPEQGPETINQVTEHKMSAE

SEQ ID NO: 127 - protein, 1429 aa, Escherichia coli
KTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPEDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSNMTVGTNLDTVYFKKHGQVTGNSAAFGFHPDFAGISVEHLSSYGDLDPQEMPLLILNGFEYVTQVGNDPYAIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKKRILDAFPGLEECKDSDYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANNAYDGGTQCSAELKQSLIDNKMIYGEGSKAGMMNPSYPLNYMEKPLTRLMLGRSWWDLNIKVDVEKYPGAVSAEGEEVTETINLYSNPTKWFAGNMQSTGLWAPAQQEVSIKSNAKVPVTVTVALADDLTGREKHEVALNRPPRVTKTYSLDASGTVKFKVPYGGLIYIKSDSKEEKSANFTFTGVVKAPFYKDGKWKNDLKSPAPLGELESASFVYTTPKKNLEASNYKGGLKQFAEDLDTFASSMNDFYGRDGESGKHRMFTYEALTGHKHRFTNDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKQWYPEGSLPAFYSEREGMKGWNLFQLMHRKARGDDVGNDKFGNRNYCAESNGNAADTLMLCASWVAQTDLSAFFKKWNPGANAYQLPGATEMSFEGGVSQSAYNTLASLDLPKPEQGPETINQVTEHKMSAE

SEQ ID NO: 128 - protein, 1435 aa, Escherichia coli
KTGYLTLGGSQRITGATCNGESSDGFTFTPGDKVTCVAGNNTTIATFDTQSEAARSLRAVEKVSFSLEDAQELAASDDKKSNAVSLVTSSNSCPADTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGDQNVVLPNEFIEQFKTGQAKEIDTAICAKTDGCNEARWFSLTTRNVNDGQIQGVINKLWGVDKDYKSVTKFHVFHDSTNFYGSTGNARGQAVVNISNAAFPILMARNDKNYWLAFGEKRAWDKNELAYITEAPSIVQPENVTRDTATFNLPFISLGQVGEGKLMVIGNPHYNSILRCPNGYSWNGGVNKDGQCTLSGDSDDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNTDPQGYPNRVRQQREKGIWVYERYPAVDSAQPPYTIDPDTGKVTWKYQEEGKPDDKPKLEVASWQEDVDGKQVTRYAFIDEAEHSTEESLEAAKAKIFEKFPGLQECKDSTYHYEINCLERRPGTDVPVTGGMYVPRYTQLNLDADTAKAMVQAADLGTNIQRLYQHELYFRTNGRKGERLSSVDLERLYQNMSVWLWNKIEYRYENDKDDELGFKTFTEFLNCYANNAYSEGTQCSADLKKSLVDNNMIYGDGSSKAGMMNPSYPLNYMEKPLTRLMLGRSWWDLNIKVDVEKYPGAVSAEGEKVTETISLYSNPTKWFAGNMQSTGLWAPAQQEVTIESTASVPVTVTVALADDLTGREKHEVALNRPPKVTKTYDLKANDKVTFKVPYGGLIYIKGNSPKNESAEFTFTGVVKAPFYKDGEWKNALNSPAPLGELESDSFVYTAPKNNLNASNYSNYTDGVAEFAKELDTFASSMNDFYGRDGESGNHRMFTYKALTGHKHRFANDVQISIGDAHSGYPVMNSSFSTNSTTLPTTPLNDWLIWHEVGHNAAETPLNVPGATEVANNVLALYMQDRYLGKMNRVADDITVAPEYLDESNGQAWARGGAGDRLLMYAQLKEWAEENFDIKQWYPDGELPKFYSDRKGMKGWNLFQLMHRKARGDDVSNDKFGGRNYCAESNGNAADTLMLCASWVAQADLSEFFKKWNPGANAYQLPGASEMSFEGGVSQSAYNTLAAMHLSKPEKGPETINKVTEYSMPAE

SEQ ID NO: 129 - protein, 1521 aa, Escherichia coli
MNKKFKYKKSLLAAILSATLLAGCDGGGSGSSSDTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPATTPGTKPDLNASFVSANAEQFYQYQPTEIILSEGRLVDSQGDGVVGVNYYTNSGRGVTGENGEFSFSWGETISFGIDTFELGSVRGNKSTIALTELGDEVRGANIDQLIHRYSKAGQNHTRVVPDEVRKVFAEYPNVINEIINLSLSNGATLGEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSSMTVGTNLDTVYFKKHGQVLGNSAPFAFHKDFTGITVKPMTSYGNLNPDEVPLLILNGFEYVTQWGSDPYSIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGTGVPVTGGMYVPQYTQLDLGADTAKAMLQAADLGTNIQRLYQHELYFRTNGLQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGVVNTNGETVTQNINLYSAPTKWFAGNMQSTGLWAPAQQEVSIESKATVPVTVTVALADDLTGREKHEVSLNRPPRVTKTYDLKANDKVTFKVPYGGLIYIKGDSKEVQSADFTFTGVVKAPFYKDGKWQHDLNSPAPLGELESASFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGATEMSFEGGVSQSAYNTLASLNLPKPKQGPETINKVTEYSMPAE

SEQ ID NO: 130 - protein, 1488 aa, Escherichia coli
DTPPVDSGTGSLPEVKPDPTPNPEPTPEPTPDPEPTPEPTPDPEPTPEPEPEPVPTKTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPATTPGTKPDLNASFVSANAEQFYQYQPTEIILSEGRLVDSQGDGVVGVNYYTNSGRGVTGENGEFSFSWGETISFGIDTFELGSVRGNKSTIALTELGDEVRGANIDQLIHRYSKAGQNHTRVVPDEVRKVFAEYPNVINEIINLSLSNGATLGEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSSMTVGTNLDTVYFKKHGQVLGNSAPFAFHKDFTGITVKPMTSYGNLNPDEVPLLILNGFEYVTQWGSDPYSIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGTGVPVTGGMYVPQYTQLDLGADTAKAMLQAADLGTNIQRLYQHELYFRTNGLQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGVVNTNGETVTQNINLYSAPTKWFAGNMQSTGLWAPAQQEVSIESKATVPVTVTVALADDLTGREKHEVSLNRPPRVTKTYDLKANDKVTFKVPYGGLIYIKGDSKEVQSADFTFTGVVKAPFYKDGKWQHDLNSPAPLGELESASFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGATEMSFEGGVSQSAYNTLASLNLPKPKQGPETINKVTEYSMPAE

SEQ ID NO: 131 - protein, 1432 aa, Escherichia coli
KTGYLTLGGSLRVTGDITCNDESSDGFTFTPGDKVTCVAGNNTTIATFDTQSEAARSLRAVEKVSFSLEDAQELAGSDNKKSNALSLVTSMNSCPANTEQVCLEFSSVIESKRFDSLYKQIDLAPEEFKKLVNEEVENNAATDKAPSTHTSPVVPATTPGTKPDLNASFVSANAEQFYQYQPTEIILSEGRLVDSQGDGVVGVNYYTNSGRGVTGENGEFSFSWGETISFGIDTFELGSVRGNKSTIALTELGDEVRGANIDQLIHRYSKAGQNHTRVVPDEVRKVFAEYPNVINEIINLSLSNGATLGEGEQVVNLPNEFIEQFKTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSIVRPENVTRETATFNLPFISLGQVGDGKLMVIGNPHYNSILRCPNGYSWNGGVNKDGQCTLNSDPDDMKNFMENVLRYLSNDRWLPDAKSSMTVGTNLDTVYFKKHGQVLGNSAPFAFHKDFTGITVKPMTSYGNLNPDEVPLLILNGFEYVTQWGSDPYSIPLRADTSKPKLTQQDVTDLIAYMNKGGSVLIMENVMSNLKEESASGFVRLLDAAGLSMALNKSVVNNDPQGYPDRVRQRRSTPIWVYERYPAVDGKPPYTIDDTTKEVIWKYQQENKPDDKPKLEVASWQEEVEGKQVTQFAFIDEADHKTPESLAAAKQRILDAFPGLEVCKDSDYHYEVNCLEYRPGTGVPVTGGMYVPQYTQLDLGADTAKAMLQAADLGTNIQRLYQHELYFRTNGLQGERLNSVDLERLYQNMSVWLWNETKYRYEEGKEDELGFKTFTEFLNCYTNNAYVGTQCSAELKKSLIDNKMIYGEESSKAGMMNPSYPLNYMEKPLTRLMLGRSWWDLNIKVDVEKYPGVVNTNGETVTQNINLYSAPTKWFAGNMQSTGLWAPAQQEVSIESKATVPVTVTVALADDLTGREKHEVSLNRPPRVTKTYDLKANDKVTFKVPYGGLIYIKGDSKEVQSADFTFTGVVKAPFYKDGKWQHDLNSPAPLGELESASFVYTTPKKNLNASNYTGGLEQFANDLDTFASSMNDFYGRDSEDGKHRMFTYKNLPGHKHRFANDVQISIGDAHSGYPVMNSSFSPNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGATEMSFEGGVSQSAYNTLASLNLPKPKQGPETINKVTEYSMPAE

SEQ ID NO: 132 - DNA, 4563 bp, Escherichia coli
atgaataagaaatttaaatataagaaatcgcttttagcggctattttgagtgcaaccctgttagccggttgtgatggcggtggctccggatcttcctccgatacgccgcctgtagattctggaacagggtctttgccggaagtgaaacctgatccaacaccaaacccggagccgacacctgagccaacgccggacccagaacctacgccggaaccgacacctgatcctgagccaacaccagaaccggagccagaacctgttcctacgaaaacgggttatctgactctgggcggaagcctgcgggtaactggtgatatcacctgtaatgatgaatccagcgatggctttacctttacaccaggcgacaaagtcacctgtgtggcagggaacaacacgacaattgctaccttcgacacccagtcagaagctgcgcgtagcctgcgtgcggttgaaaaagtgtcgtttagtcttgaggacgcgcaagaactggcgggttccgacaacaagaaaagcaatgcgctctcgctggtcacctccatgaacagttgcccggcgaatacagaacaggtgtgcctggagttctcctcggtgatcgagagtaaacgtttcgactcgctgtataagcaaatcgatctggcaccggaagaattcaaaaagctggtcaatgaagaggtggaaaacaatgccgcgaccgataaagcgccatccactcatacttcaccggtcgtgcccgccaccactccgggaacaaaaccggatctaaacgcttccttcgtgtcggctaacgcggaacagttttatcagtatcaacccactgaaatcattctctctgaaggtcgactggtcgatagtcagggggatggtgttgttggtgtcaactattacaccaattccggccgtggtgtaaccggagaaaacggggaattttcctttagttggggggaaaccatctcctttggcatcgacacttttgagcttggttctgtgcgtggtaacaagtcgactattgcattgactgaactgggtgatgaagttcgcggggcaaatatcgatcagttgattcaccgctattcgaaggctggacaaaatcacacgcgtgtagttccggatgaagtgcgcaaggtttttgctgaatatcccaacgtgattaacgagattatcaatctctcgttatccaatggtgcgacgctgggggaaggtgagcaagtcgttaatctgcctaacgaatttatcgagcagtttaagacgggtcaggccaaagagatcgataccgcgatttgtgcgaaaaccgatggttgtaacgaggctcgctggttctcgctgacaacgcgcaatgttaatgacggccagattcagggcgttatcaacaagctgtggggcgtggatacgaactacaaatctgtcagtaagttccatgtattccatgactctaccaacttctatggcagcacgggtaatgcgcgcggtcaggcggtggtgaatatctccaacgcggccttcccgattctgatggcgcgtaatgataaaaactactggctggcgtttggcgaaaaacgcgcctgggataaaaatgagctggcgtacattactgaagcgccttccattgtgcgaccagagaacgtgacacgcgaaaccgccaccttcaacctgccgtttatctcgctggggcaagtgggcgatggcaagctgatggttatcggtaacccacactacaacagcatcctgcgttgcccgaacggctacagctggaacgggggcgttaataaagacggacagtgtacgctcaacagcgacccggatgacatgaagaacttcatggagaacgtgctgcgctatctgtcaaatgatcgctggttgccggatgcaaaatccagtatgaccgtgggtactaacctggacacggtatatttcaaaaaacatggtcaggtgctgggaaatagcgcaccgtttgcgttccacaaggatttcactggcatcacggtcaaaccaatgaccagctatggcaatctgaatccagatgaagttcctctgttgatcctcaatggctttgaatacgtcacacaatggggtagcgatccttactccattcctctgcgcgcagataccagcaaaccgaagctgacccagcaggatgtgaccgatttgatcgcctatatgaacaaaggtggatcggtgctgatcatggaaaacgtgatgagcaatcttaaggaagagagcgcatctggctttgtacgtctgcttgatgccgcaggtttgtcgatggcgcttaacaagtcggtagtaaataacgatccgcaaggctaccctgaccgtgttcgtcaacgacgttcaacgccaatttgggtctatgagcgttatccggctgtcgatggtaaaccaccgtataccattgatgacaccacgaaagaagttatctggaaatatcagcaagaaaacaaacctgatgacaaaccgaagctggaagttgccagctggcaggaagaagttgagggtaaacaggtaacccaattcgcctttattgatgaagccgaccacaaaacgcctgagtcactggctgcggcaaaacagagaattctggacgcgttcccagggctggaagtgtgtaaggattctgactatcactatgaggtcaactgtctggaataccgcccaggcacgggtgtgccggtaaccggtggcatgtatgttccgcagtatacgcagctggatcttggagctgacactgcgaaagcgatgctgcaggctgcggatttaggcaccaatattcagcgcctgtatcagcatgagctttatttccgtaccaatggcctccagggtgagcgtctcaacagcgttgatctggaacgtttataccaaaacatgtccgtctggctgtggaacgagacgaaatatcgttatgaagagggtaaagaagacgagctgggctttaaaacgttcactgagtttctgaactgctacaccaacaatgcatacgttggcacgcagtgttctgctgagctgaaaaaatcgctgatcgataacaagatgatttatggtgaagaaagcagcaaagcgggcatgatgaacccgagctacccgctcaactatatggaaaaaccgctgacacgcctgatgctgggccgttcctggtgggatctgaacatcaaagttgatgttgagaagtatccgggagtggtgaatacaaacggcgaaaccgtcacacaaaacattaacttgtactcagctccaaccaaatggtttgcaggtaacatgcagtcaactggcctgtgggcacctgcccagcaggaagtcagcattgagtcaaaggcgacagttcctgtgaccgtgactgttgcgctggccgacgacctgacaggacgagagaagcatgaagttagcctgaatcgtccacccagagtgacaaaaacctatgacctgaaagccaatgataaggtgacgttcaaagtcccttacggtggtctgatttacatcaagggcgacagcaaagaggtgcaatcagctgacttcacctttaccggtgtagtaaaagcgccgttctataaagacggtaagtggcaacacgatctgaactcccctgccccgctgggcgaactggagtctgcctcgttcgtctataccacaccgaagaagaacctgaatgccagcaattacactggcggactggagcaattcgctaacgatctggatacctttgccagctcgatgaatgacttctacggccgtgatagcgaagacggtaagcaccggatgtttacctataaaaacttgccgggccacaaacatcgtttcgccaacgatgtgcagatctccatcggtgatgcgcattcgggttatccggtaatgaacagcagcttctcgccgaacagcaccacgctgccgacgacgccgctgaacgactggctgatctggcatgaagtcggtcataacgccgcagaaacgccgttgactgtaccgggtgcaactgaagtcgctaacaacgtgctggcgctgtacatgcaggatcgttatctcggcaagatgaaccgtgtcgctgacgatattaccgtcgcaccggaatatctggaggaaagcaacggtcaggcatgggcgcgcggcggtgcgggtgaccgtctgctgatgtacgcacagctgaaggaatgggcagagaaaaactttgatatcaagaaatggtatccagatggcactcctctgccagagttttacagcgagcgtgaagggatgaaaggctggaacctgttccagttgatgcatcgtaaagcacgcggcgatgaggtcagcaatgacaagtttggcggcaagaattactgtgctgaatccaacggtaacgcagcggacacgctgatgctgtgtgcctcctgggtcgcccagacggatctttcggagttctttaagaaatggaatccgggcgcgaatgcttaccagttgccgggagcgacggagatgagcttcgaaggcggtgtgagccagtcggcgtacaacacgctggcgtcactcaatctgccgaaaccgaagcaagggccggaaaccattaacaaggttaccgagtattcgatgcctgctgaa

SEQ ID NO: 133 - protein, 1518 aa, Escherichia coli
MNKKFKYKKSLLAAILSATLLAGCDGGGSGSSSDTPPVDSGTGSLPEVKPDPTPNPEPTPEPTPDPEPTPEPTPDPEPEPEPEPVPTKTGYLTLGGSQRVTGATCNGESSDGFTFTPGEDVTCVAGNTTIATFDTQSEAARSLRAVEKVSFSLEDAQELAASDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAEYPNVINEIINLSLSNGEALSEGDQTFERTNEFLEQFESGQAKEIDTAICDSLGGCNSQRWFSLTARNVNEGQIQGVINKLWGVDKDYKSVTKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKAKIFEKFPGLKECKDPTYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESSASVPVTVTVALADDLTGREKHEVALNRPPKVTKTYDLKANDKVTFKVPYGGLIYIKGNSPKNESAEFTFTGVVKAPFYKDGEWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKQWYPEGDLPKFYSDREGMKGWNLFQLMHRKARGDDVGKTKFGERNYCAESNGNAADKLMLCASWVAQTDLSEFFKKWNPGANAYQLPGASEMNFEGGVSQSAYETLAALNLPKPQQGPETINQVTEHKMSAE

SEQ ID NO: 134 - protein, 1485 aa, Escherichia coli
DTPPVDSGTGSLPEVKPDPTPNPEPTPEPTPDPEPTPEPTPDPEPEPEPEPVPTKTGYLTLGGSQRVTGATCNGESSDGFTFTPGEDVTCVAGNTTIATFDTQSEAARSLRAVEKVSFSLEDAQELAASDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAEYPNVINEIINLSLSNGEALSEGDQTFERTNEFLEQFESGQAKEIDTAICDSLGGCNSQRWFSLTARNVNEGQIQGVINKLWGVDKDYKSVTKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKAKIFEKFPGLKECKDPTYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESSASVPVTVTVALADDLTGREKHEVALNRPPKVTKTYDLKANDKVTFKVPYGGLIYIKGNSPKNESAEFTFTGVVKAPFYKDGEWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKQWYPEGDLPKFYSDREGMKGWNLFQLMHRKARGDDVGKTKFGERNYCAESNGNAADKLMLCASWVAQTDLSEFFKKWNPGANAYQLPGASEMNFEGGVSQSAYETLAALNLPKPQQGPETINQVTEHKMSAE

SEQ ID NO: 135 - protein, 1431 aa, Escherichia coli
KTGYLTLGGSQRVTGATCNGESSDGFTFTPGEDVTCVAGNTTIATFDTQSEAARSLRAVEKVSFSLEDAQELAASDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSMGNGVVGVNYYTSSGRGVTGENGKFNFSWGETISFGIDTFELGSVRGNKSTIALTELGDEVRGANIDQLIHRYSQAGKNDEREVPDVVRKVFAEYPNVINEIINLSLSNGEALSEGDQTFERTNEFLEQFESGQAKEIDTAICDSLGGCNSQRWFSLTARNVNEGQIQGVINKLWGVDKDYKSVTKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWEGGVDKNGQCTRNSDSNDMKHFMQNVLRYLSDDKWTPDAKASMTVGTNLDTVYFKRHGQVTGNSAEFGFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKAKIFEKFPGLKECKDPTYHYEVNCLEYRPGTGVPVTGGMYVPQYTQLSLNADTAKAMVQAADLGTNIQRLYQHELYFRTNGRKGERLSSVDLERLYQNMSVWLWNKIEYRYENDKDDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESSASVPVTVTVALADDLTGREKHEVALNRPPKVTKTYDLKANDKVTFKVPYGGLIYIKGNSPKNESAEFTFTGVVKAPFYKDGEWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKQWYPEGDLPKFYSDREGMKGWNLFQLMHRKARGDDVGKTKFGERNYCAESNGNAADKLMLCASWVAQTDLSEFFKKWNPGANAYQLPGASEMNFEGGVSQSAYETLAALNLPKPQQGPETINQVTEHKMSAE

SEQ ID NO: 136 - DNA, 4554 bp, Escherichia coli
atgaataagaaatttaaatataagaaatcgcttttagcggctattttgagtgcaaccctgttagccggttgtgatggcggtggctccggatcttcctccgatacgccgcctgtagattctggaacagggtctttgccggaagtgaaacctgatccaacaccaaacccggagccgacgcctgagccaacgccggacccagaacctacgccggaaccgacacctgatcctgagccagaaccggagccagaacctgttcctacgaaaacgggttatctgaccctgggcggaagccagcgggtaactggtgctacttgtaatggtgaatccagcgatggctttacatttacacctggtgaggacgttacttgcgtggcgggtaacacgacaattgctaccttcgacacccagtcagaagctgcgcgtagcctgcgtgcggttgaaaaagtgtcgtttagtcttgaggacgcgcaagaactggcagcttccgatgacaagaaaagcaatgcggtttcgctggtaacgtccagtaacagctgtccggcgaatacagaacaggtttgcctgacgttctcctcagtgatcgagagtaaacgtttcgactcgctgtataagcaaatcgatctggcaccggaagagttcaaaaagctggtcaatgaagaggtggaaaacaatgccgcgaccgataaagcgccatccactcatacttcaccggttgtgcccgtcaccacgccgggaacaaaaccggatctgaacgcttccttcgtgtcggctaacgcggaacagttttatcagtatcaacccactgaaatcattctctccgaaggccgactggtagatagcatgggcaatggtgtggttggcgtaaattactacaccagctcaggccgtggcgtaactggcgaaaacggcaaattcaacttcagctggggcgaaaccatctcctttggtatcgacacctttgaactgggctcagtgcgcggcaataagtcgaccattgcgttgactgaactgggtgacgaagttcgcggcgcgaatattgatcagcttattcatcgttactcccaggccggaaaaaatgatgagcgtgaagtgccggacgtagtgcgcaaggtctttgccgagtatcccaacgtaatcaacgagattatcaatctctcgttatccaatggcgaggcgttgagcgaaggcgatcaaacctttgagcggacaaacgaatttcttgagcagtttgaatccgggcaggctaaagagattgatacggcgatttgtgactcccttgggggctgcaactctcagcgttggttctcgttgacagcacgcaatgttaacgaaggtcagattcagggcgttatcaacaagctgtggggtgtggataaagattacaaatcagtgacgaaattccacgtcttccatgactctaccaacttctatggcagtaccggtaatgcgcgcggtcaggcagtggtgaatatctccaacgcggccttcccgattctgatggcgcgtaatgataaaaactactggctggcgtttggcgaaaaacgcgcctgggataaaaacgagctggcgtacattacggaagcgccttctctcgttgagccggaaaacgttacgcgcgataccgccacctttaacctgccgtttatttcgctggggcaagtcggtgagggcaaactgatggttatcggtaacccgcactacaacagcattttgcgttgtccgaacggttacagctgggaaggcggtgttgataaaaacggtcagtgtacgcgtaacagtgattctaatgatatgaagcactttatgcagaacgtgttgcgctatctgtccgacgataaatggacgccggacgcgaaagccagcatgaccgtaggcaccaacctggatactgtctatttcaaacgtcatggtcaggttacaggaaacagcgctgagttcggctttcatccggattttgcgggtatctctgttgagcatttaagtagctatggcgatctcgacccgcaggaaatgccgctgctgatcctcaacggctttgagtatgtgactcaggttggtaacgatccttatgcaatcccgctgcgagcagataccagcaaaccgaagctgactcagcaggatgtgaccgatctgatcgcctatctgaacaaaggtggatcggtgctgatcatggaaaacgtgatgagcaatcttaaggaagagagcgcgtctggctttgtacgtctgcttgatgccgcaggtctgtcgatggcactgaacaagtcggtagtaaataacgatccgcaagggtatccgaaccgcgttcgtcagcagcgcgcaacgggcatttgggtctatgaacgttatcctgccgtagatggtgcgctgccgtacaccatcgatagtaagacaggggaagttaagtggaaatatcaggtagaaaacaaacctgatgacaaaccgaagctggaagttgccagctggctggaagatgtagatggcaaacaggaaacgcgttatgcctttattgatgaggccgatcataaaacagaggattctctgaaggctgcgaaggcaaaaatctttgagaagtttcctggattaaaggagtgtaaggacccaacttaccactacgaggtcaactgtctggaatatcgtcctggcacgggggttccggttactggtggcatgtatgttccacagtatacgcaactaagccttaacgccgacacggcaaaagcgatggtgcaggctgcggatttaggcaccaacattcagcgtctgtatcagcatgagctctacttccggaccaatggtcgcaaaggtgagcgtctgagcagcgtcgatctggaacgtctgtaccagaacatgtcggtctggctgtggaataaaattgaatatcgctatgaaaacgacaaggatgacgagctgggctttaaaacgttcaccgagttcctgaactgctacgccaacgatgcctatactggcggcacgcagtgttctgatgagctgaaaaaatcgctggtcgataacaacatgatctacggcgagaagagcgttaataaagcgggcatgatgaacccgagctatccgctcaactatatggaaaaaccgctgacgcgcctgatgctgggtcgttcctggtgggatctaaacatcaaagttgatgtcgagaagtatccgggagcggtatcggcagaaggtgagaaggttactgaaaccatcagcctgtactccaatccgaccaaatggtttgcgggtaacatgcagtctactggcctgtgggctccggctcagaaagaggtcaccattgagtcttctgcatcagttcctgtgactgtcaccgtggcgctggccgacgatctgaccggacgcgagaagcatgaagtcgcgctgaaccgtccgccaaaagtgacgaaaacctatgatctgaaagccaatgataaggtgaccttcaaggtgccttacggtggtctgatttatatcaagggcaacagcccaaagaatgagtcagccgaattcacctttactggtgtggtaaaagcgccgttctataaagacggcgaatggaaaaacgctctgaactcccctgcgccgctgggcgagctggaatcagacgctttcgtttataccacgccgaagaagaaccttgaggctagcaatttcactggtggtgtagcagaattcgctaaagatctggatacctttgccagctcgatgaatgacttctacggtcgtaatgatgaagacggtaagcaccggatgtttacctataaaaacttgacggggcacaagcatcgtttcaccaacgatgtgcagatctccatcggtgatgcgcactcgggttatccggtaatgaacagcagcttctcgacgaacagcaccacgctgccgacgacgccgctgaacgactggttgatctggcacgaagtagggcacaacgccgccgaaacgccgctgactgttcctggcgcaactgaagtagcgaacaacgttctggcgctgtacatgcaggatcgctatctcggcaagatgaaccgtgtcgctgacgatattactgtcgcgccggaatatctggaggagagcaacggtcaggcatgggcgcgcggcggtgcgggcgaccgtctgctgatgtacgcgcagctgaaggagtgggcagagaaaaactttgatatcaaacagtggtatccagaaggtgacctgcctaagttctacagcgatcgtgaagggatgaaaggctggaacctgttccagttgatgcaccgtaaagcacgcggcgatgatgttggcaaaaccaagtttggcgaaagaaattactgtgccgaatccaacggtaacgctgccgacaagctgatgctgtgtgcctcctgggtcgctcagacggatctttcggagttctttaagaaatggaatccgggcgcgaatgcttaccagttaccgggagcgagcgagatgaacttcgagggcggtgtgagccagtcggcttacgagacgctggcggcgcttaatctgccgaaaccgcagcaagggccggaaaccattaatcaggttaccgagcataagatgtcagctgag

SEQ ID NO: 137 - protein, 1520 aa, Escherichia coli
MNKKFKYKKSLLAAILSATLLAGCDGGGSGSSSDTPPVDSGTGSLPEVKPDPTPNPEPTPEPTPDPEPTPEPIPDPEPTPEPEPEPVPTKTGYLTLGGSQRVTGATCNGESSDGFTFTPGEDVTCVAGNTTIATFNTQSEAARSLRAVEKVSFSLEDAQELAASDNKKSNAVSLVTSSNSCPADTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGEQVVNLPNEFIEQFKTGQAKEIDTAICAKTDGCNEARWFSLTTRNVNDGQIQGVINKLWGVDTSYKSVSKFHVFHDSTNFYGSTGNARGQAVVNISNAAFPILMARNDKNYWLAFGEKRAWDKNELAYITEAPSIVRPENVTRETATFNLPFISLGQVGKGKLMVIGNPHYNSILRCPNGYSWEGGVDKNGQCTRNSDSNDMKHFMQNVLRYLSNDKWTPDAKASMTVGTNLDTVYFKRHGQVTGNSAEFGFHPDFAGISVEHLSSYGDLDPQKMPLLILNGFEYVTQVGGDPYAVPLRADTSKPKLTQQDVTDLIAYMNKGGSVLIMENVMSNLKEESASGFVRLLDAAGLSMALNKSVVNNDPQGYPDRVRQRRATGIWVYERYPVVEGELPYTIDSKTGKVTWKYQIDNKPDKKPKLEVASWQEEVDGKQVTQFAFIDEADHKTTESLDAAKKKILEKFKGLEECKDSTYHYEINCLEYRPGTNVPVTGGMYVPRYTQLNLSADTAKAMVQAADLGTNIQRLYQHELYFRTNGRKGERLSSVDLERLYQNMSVWLWNEIEYSYDSSKEDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESSASVPVTVTVALADDLTGREKHEVALNRPPKVTKTYDLKANDKVTFKVPYGGLIYIKGNSPKNESAEFTFTGVVKAPFYKDGEWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKTWYPDGNLPAFYSEREGMKGWNLFQLMHRKARGDEVGKTKFGERNYCAESNGNAADTLMLCASWVAQTDLSEFFKKWNPGANAYQLPGASEMNFEGGVSQSAYETLAALNLPKPQQGPETINQVTEHKMSAE

SEQ ID NO: 138 - protein, 1487 aa, Escherichia coli
DTPPVDSGTGSLPEVKPDPTPNPEPTPEPTPDPEPTPEPIPDPEPTPEPEPEPVPTKTGYLTLGGSQRVTGATCNGESSDGFTFTPGEDVTCVAGNTTIATFNTQSEAARSLRAVEKVSFSLEDAQELAASDNKKSNAVSLVTSSNSCPADTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGEQVVNLPNEFIEQFKTGQAKEIDTAICAKTDGCNEARWFSLTTRNVNDGQIQGVINKLWGVDTSYKSVSKFHVFHDSTNFYGSTGNARGQAVVNISNAAFPILMARNDKNYWLAFGEKRAWDKNELAYITEAPSIVRPENVTRETATFNLPFISLGQVGKGKLMVIGNPHYNSILRCPNGYSWEGGVDKNGQCTRNSDSNDMKHFMQNVLRYLSNDKWTPDAKASMTVGTNLDTVYFKRHGQVTGNSAEFGFHPDFAGISVEHLSSYGDLDPQKMPLLILNGFEYVTQVGGDPYAVPLRADTSKPKLTQQDVTDLIAYMNKGGSVLIMENVMSNLKEESASGFVRLLDAAGLSMALNKSVVNNDPQGYPDRVRQRRATGIWVYERYPVVEGELPYTIDSKTGKVTWKYQIDNKPDKKPKLEVASWQEEVDGKQVTQFAFIDEADHKTTESLDAAKKKILEKFKGLEECKDSTYHYEINCLEYRPGTNVPVTGGMYVPRYTQLNLSADTAKAMVQAADLGTNIQRLYQHELYFRTNGRKGERLSSVDLERLYQNMSVWLWNEIEYSYDSSKEDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESSASVPVTVTVALADDLTGREKHEVALNRPPKVTKTYDLKANDKVTFKVPYGGLIYIKGNSPKNESAEFTFTGVVKAPFYKDGEWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKTWYPDGNLPAFYSEREGMKGWNLFQLMHRKARGDEVGKTKFGERNYCAESNGNAADTLMLCASWVAQTDLSEFFKKWNPGANAYQLPGASEMNFEGGVSQSAYETLAALNLPKPQQGPETINQVTEHKMSAE

SEQ ID NO: 139 - protein, 1431 aa, Escherichia coli
KTGYLTLGGSQRVTGATCNGESSDGFTFTPGEDVTCVAGNTTIATFNTQSEAARSLRAVEKVSFSLEDAQELAASDNKKSNAVSLVTSSNSCPADTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLDEGEQVVNLPNEFIEQFKTGQAKEIDTAICAKTDGCNEARWFSLTTRNVNDGQIQGVINKLWGVDTSYKSVSKFHVFHDSTNFYGSTGNARGQAVVNISNAAFPILMARNDKNYWLAFGEKRAWDKNELAYITEAPSIVRPENVTRETATFNLPFISLGQVGKGKLMVIGNPHYNSILRCPNGYSWEGGVDKNGQCTRNSDSNDMKHFMQNVLRYLSNDKWTPDAKASMTVGTNLDTVYFKRHGQVTGNSAEFGFHPDFAGISVEHLSSYGDLDPQKMPLLILNGFEYVTQVGGDPYAVPLRADTSKPKLTQQDVTDLIAYMNKGGSVLIMENVMSNLKEESASGFVRLLDAAGLSMALNKSVVNNDPQGYPDRVRQRRATGIWVYERYPVVEGELPYTIDSKTGKVTWKYQIDNKPDKKPKLEVASWQEEVDGKQVTQFAFIDEADHKTTESLDAAKKKILEKFKGLEECKDSTYHYEINCLEYRPGTNVPVTGGMYVPRYTQLNLSADTAKAMVQAADLGTNIQRLYQHELYFRTNGRKGERLSSVDLERLYQNMSVWLWNEIEYSYDSSKEDELGFKTFTEFLNCYANDAYTGGTQCSDELKKSLVDNNMIYGEKSVNKAGMMNPSYPLNYMEKPLTRLMLGRSWWDLNIKVDVEKYPGAVSAEGEKVTETISLYSNPTKWFAGNMQSTGLWAPAQKEVTIESSASVPVTVTVALADDLTGREKHEVALNRPPKVTKTYDLKANDKVTFKVPYGGLIYIKGNSPKNESAEFTFTGVVKAPFYKDGEWKNALNSPAPLGELESDAFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLTVPGATEVANNVLALYMQDRYLGKMNRVADDITVAPEYLEESNGQAWARGGAGDRLLMYAQLKEWAEKNFDIKTWYPDGNLPAFYSEREGMKGWNLFQLMHRKARGDEVGKTKFGERNYCAESNGNAADTLMLCASWVAQTDLSEFFKKWNPGANAYQLPGASEMNFEGGVSQSAYETLAALNLPKPQQGPETINQVTEHKMSAE

SEQ ID NO: 140 - DNA, 4560 bp, Escherichia coli
atgaataagaaatttaaatataagaaatcgcttttagcggctattttgagcgcaaccctgttagccggttgtgatggcggtggttccggatcttcctccgatacgccgcctgtagattctggaacagggtctttgccggaagtgaaacctgatccaacaccaaacccggagccgacgcctgagccaacgccggacccagaacctacgccggaaccgatacctgatcctgagccaacaccagaaccggagccagaacctgttcctacgaaaacgggttatctgaccctgggcggaagccagcgggtaactggtgctacctgtaatggtgaatccagcgatggctttacatttacacctggtgaggacgttacttgcgtggcgggtaacacgacaattgccaccttcaacactcagtcagaagctgcgcgtagcctgcgtgcggttgaaaaagtgtcgtttagtcttgaggacgcgcaagaactggcggcttccgacaataagaaaagcaatgcggtttcgctggtaacgtccagtaacagctgtccggcggatacagaacaggtttgcctgacgttctcctctgtgatcgagagtaaacgtttcgactcgctgtataagcaaatcgatctggcaccggaagagttcaaaaagctggtcaatgaagaggtggaaaacaatgccgcgaccgataaagcgccatccactcatacttcaccggtcgtgcctgtcaccacgccgggaacaaaaccggatctgaacgcctccttcgtgtcggctaacgcggaacagttttatcagtatcaacctacggaaatcattctctccgaaggccgactggtagatagccagggatatggtgttgctggcgtcaactactacaccaattcaggccgtggcgtgacaggggaaaatggtgaattttcctttagctggggcgaaaccatctcctttggtatcgatacctttgaactgggttcagtgcgcggcaataagtcgaccattgcgctgactgaactgggtgatgaagttcgcggggcgaatattgatcagcttattcatcgctattcgacgaccgggcaaaataatacccgtgttgttccggacgatgtacgcaaggtctttgccgaatatcccaacgtgatcaacgagattatcaatctctcgttatccaacggtgcgacgctggatgaaggtgagcaagttgttaatctgccaaacgaatttattgagcagtttaagacgggtcaagccaaagagatcgataccgcgatttgtgcgaaaaccgacggttgtaacgaggctcgctggttctcgctgacgacgcgcaatgttaatgacggccagattcagggcgttattaacaagctgtggggtgtggatacaagttacaaatctgtcagcaagttccatgtattccatgactctaccaacttctatggcagcaccggtaatgcgcgcggtcaggcggtggtgaatatctccaacgcggcattcccgattctgatggcgcgtaatgataaaaactactggctggccttcggcgaaaaacgcgcctgggataaaaatgagctggcgtacattacggaagcgccttccattgtgcgcccggaaaacgtgactcgcgaaactgccaccttcaacctgccgtttatctcgctggggcaagtcggcaaaggtaagctgatggttatcggtaacccgcactacaacagcattctgcgctgtccgaacggttacagctgggaaggcggtgttgataaaaacggtcagtgtacgcgtaacagtgattctaatgatatgaagcactttatgcagaacgtgttgcgctatctgtccaacgataaatggacgccggacgcgaaagccagcatgaccgtaggcaccaacctggatactgtctatttcaaacgtcatggtcaggttacaggaaacagtgctgagttcggcttccatccggattttgcgggtatctccgttgagcatttaagtagctatggcgatctcgatccgcagaaaatgccgctgctgatccttaacggctttgagtatgtgactcaggtggggggcgatccctatgcagtgcctctgcgtgcagataccagcaaaccgaagctgacccagcaggatgtgaccgatttgatcgcctatatgaacaaaggtggctcggtgctgatcatggaaaacgtgatgagcaatcttaaggaagagagcgcgtctggctttgtgcgtctgctggatgccgcaggcctgtcaatggcactgaacaagtcggtggtgaataacgatccgcagggttatccagaccgcgtgcgccagcgtcgagcgactggcatttgggtttatgaacgttatccggttgtggagggtgagctgccgtacaccattgattccaaaacaggaaaagttacctggaaatatcagattgataacaagcctgataagaaaccgaaactggaagtagccagctggcaagaagaggttgatggtaaacaggtaactcaattcgcctttatcgatgaagccgaccacaaaacgactgaatctctggatgctgcgaagaagaaaattctggaaaaattcaagggattagaggagtgtaaggactcgacatatcactacgaaatcaactgcctggaataccgtcctggcacgaacgttccggttactggtggcatgtatgttccgcgctatacgcaactgaatctcagcgccgacactgcaaaagcgatggtgcaggcggcggatttaggcaccaacattcagcgtctgtatcagcatgagctctacttccggaccaatggtcgcaaaggtgagcgtctgagcagcgtcgatctggaacgtctgtaccagaacatgtcggtctggctgtggaatgaaattgaatacagctatgacagcagcaaggaagacgagctgggctttaaaacgttcaccgagttcctgaactgctacgccaacgatgcctatactggcggcacgcagtgttctgatgagctgaaaaaatcgctggtcgataacaacatgatctacggcgagaagagcgttaataaagcgggcatgatgaaccccagctatccgctcaactatatggaaaaaccgctgacgcgcctgatgctgggtcgttcctggtgggatctgaacatcaaagttgatgtcgagaagtatccgggagcggtatcggcagaaggtgagaaggttactgaaaccatcagcctgtactcgaatccgaccaaatggtttgcgggtaacatgcagtctactggcctatgggctccggctcagaaagaggtcaccattgagtcttctgcatcagttcctgtgactgtcaccgtggcgctggccgacgatctgaccggacgcgagaagcatgaagtcgcgctgaaccgtccgccaaaagtgacgaaaacctatgatctgaaagccaatgataaggtgaccttcaaggtgccttacggtggtctgatttatatcaagggcaacagcccaaagaatgagtcagccgaattcacctttactggtgtggtaaaagcgccgttctataaagacggcgaatggaaaaacgctctgaactcccctgcgccgctgggcgagctggaatcagacgctttcgtttataccacgccgaagaagaaccttgaggccagcaatttcactggtggtgtagcagaattcgctaaagatctggatacctttgccagctcgatgaatgacttctacggtcgtaatgatgaagacggtaagcaccggatgtttacctataaaaacttgacggggcacaagcatcgtttcaccaacgatgtgcagatctccatcggtgatgcgcactctggttatccggtaatgaacagcagcttctcgacgaacagcaccacgctgccgacgacgccgctgaacgactggctgatctggcacgaagttggtcacaacgccgccgaaacgccgctgactgttcctggcgcaactgaagtagcgaacaacgtgctggcgctgtacatgcaggatcgctatctcggcaagatgaaccgtgtcgctgacgacattaccgtcgcgccggaatatctggaggagagcaacggtcaggcatgggcgcgcggcggtgcgggtgaccgtctgctgatgtacgcacagctgaaagagtgggcagagaaaaactttgatatcaagacgtggtatccagatggcaatctgccagcgttctacagcgagcgtgaagggatgaaaggctggaacctgttccagttgatgcatcgtaaagcacgcggcgatgaggttggcaaaaccaagtttggcgaaagaaattactgtgccgaatccaacggtaacgctgccgacacgctgatgctgtgtgcatcctgggtcgcccagacggatctttcggagttctttaagaaatggaatccgggcgcgaatgcttaccagttgccgggagcgagcgagatgaacttcgagggcggtgtgagccagtcggcttacgagacgctggcggcgcttaatctgccgaaaccgcagcaagggccggaaaccattaatcaggttaccgagcataagatgtcagctgag

SEQ ID NO: 141 - protein, 1520 aa, Escherichia coli
MNKKFKYKKSLLAAILSATLLAGCDGGGSGSSSDTPSVDSGSGTLPEVKPDPTPTPEPTPEPTPDPEPTPDPTPDPEPTPEPEPEPVPTKTGYLTLGGSQRVTGATCNGESSDGFTFTPGNTVSCVVGSTTIATFNTQSEAARSLRAVDKVSFSLEDAQELANSENKKTNAISLVTSSDSCPADAEQLCLTFSSVVDRARFEKLYKQIDLATDNFSKLVNEEVENNAATDKAPSTHTSTVVPVTTEGTKPDLNASFVSANAEQFYQYQPTEIILSEGQLVDSLGNGVAGVDYYTNSGRGVTDENGKFSFSWGETISFGIDTFELGSVRGNKSTIALTELGDEVRGANIDQLIHRYSTTGQNNTRVVPDDVRKVFAEYPNVINEIINLSLSNGATLDEGDQNVVLPNEFIEQFKTGQAKEIDTAICAKTDGCNEARWFSLTTRNVNDGQIQGVINKLWGVDTNYQSVSKFHVFHDSTNFYGSTGNARGQAVVNISNSAFPILMARNDKNYWLAFGEKRAWDKNELAYITEAPSIVQPENVTRDTATFNLPFISLGQVGEGKLMVIGNPHYNSILRCPNGYSWGGGVNSKGECTLSGDSDDMKHFMQNVLRYLSNDIWQPNTKSIMTVGTNLENVYFKKAGQVLGNSAPFAFHEDFTGITVKQLTSYGDLNPEEIPLLILNGFEYVTQWSGDPYAVPLRADTSKPKLTQQDVTDLIAYLNKGGSVLIMENVMSNLKEESASSFVRLLDAAGLSMALNKSVVNNDPQGYPDRVRQRRATGIWVYERYPAADGAQPPYTIDPNTGEVTWKYQQDNKPDDKPKLEVASWQEEVEGKQVTRYAFIDEAEYTTEESLEAAKAKIFEKFPGLQECKDSTYHYEINCLERRPGTDVPVTGGMYVPRYTQLNLDADTAKAMVQAADLGTNIQRLYQHELYFRTKGSKGERLNSVDLERLYQNMSVWLWNDTKYRYEEGKEDELGFKTFTEFLNCYANDAYAGGTKCSADLKKSLVDNNMIYGDGSSKAGMMNPSYPLNYMEKPLTRLMLGRSWWDLNIKVDVEKYPGSVSAKGESVTENISLYSNPTKWFAGNMQSTGLWAPAQQDVTIKSSASVPVTVTVALADDLTGREKHEVALNRPPRVTKTYTLEANGEVTFKVPYGGLIYIKGDSKDDVSANFTFTGVVKAPFYKDGEWKNDLDSPAPLGELESASFVYTTPKKNLEASNFTGGVAEFAKDLDTFASSMNDFYGRNDEDGKHRMFTYKNLTGHKHRFTNDVQISIGDAHSGYPVMNSSFSTNSTTLPTTPLNDWLIWHEVGHNAAETPLNVPGATEVANNVLALYMQDRYLGKMNRVADDITVAPEYLDESNGQAWARGGAGDRLLMYAQLKEWAEENFDIKQWYPDGELPKFYSDRKGMKGWNLFQLMHRKARGDDVGNSTFGGKNYCAESNGNAADTLMLCASWVAQADLSEFFKKWNPGASAYQLPGATEMSFQGGVSSSAYSTLASLKLPKPEKGPETINKVTEHKMSAE

SEQ ID NO: 142 - protein, 1487 aa, Escherichia coli; identical to SEQ ID NO: 99

SEQ ID NO: 143 - protein, 1431 aa, Escherichia coli; identical to SEQ ID NO: 114

SEQ ID NO: 144 - DNA, 4560 bp, Escherichia coli
atgaataagaaatttaaatataagaaatcgcttttagcggctattttaagcgcaaccctgttagccggttgtgatggtggtggttcaggatcgtcctccgatacgccgtctgtagattctggatcagggactttgccggaagtgaaacccgatccaacaccaaccccggagccgacacctgagccgacgccggacccagaacctacgccggatccaacacctgatcctgagccgacaccagaaccggagccagaacctgttcctacgaaaacgggttatctgaccctgggcggaagccagcgggtaactggtgctacctgtaatggtgaatccagcgatggctttacctttacgccaggcaataccgtgagttgtgtggtgggcagtacgaccattgcaacattcaacacccagtcagaagctgcgcgtagcctgcgtgcggttgacaaagtgtcgtttagcctggaggacgcgcaggagctggcgaattctgaaaataagaaaaccaacgccatctctctggtgacgtccagcgacagttgccccgcagatgcagaacagctttgtcttactttctcgtcagtggttgatcgcgcgcgatttgaaaaactgtataagcaaattgatctggcaacagacaatttcagcaagctggtcaatgaagaggtggaaaacaatgctgcgactgataaagcgccgtccacccatacctcaacggtagtgccagtcacgacagagggaacaaaaccggatctgaacgcgtccttcgtgtcggctaacgcggaacagttttatcagtatcaacccactgaaatcattctttccgaaggccaactggtggatagcctggggaacggtgttgctggcgttgactactacaccaattcaggccgtggcgtaactgacgaaaacggtaaattttcctttagctggggcgaaaccatctcctttggtatcgatacctttgaactgggctcagtacgtggcaataagtcgaccattgcgctgactgaattgggtgatgaagttcgcggggcaaatatcgatcagctcattcatcgttattcgacgactggtcaaaataatactcgtgttgttccggacgatgtacgcaaggtctttgccgaatatcccaacgtgatcaacgagataatcaatctttcgttatccaacggtgcgacgctggatgaaggcgatcaaaacgttgtgctgcctaacgaatttatcgagcagtttaagacgggtcaggccaaagagatcgataccgcgatttgtgcgaaaaccgacggttgtaacgaggctcgctggttctcgctgacaacgcgcaatgttaatgacggccagattcagggcgttattaacaagctgtggggcgtggatacgaactatcagtctgtcagcaagttccacgtcttccatgactctaccaacttctatggcagtaccggtaacgcgcgcggtcaggcggtggtaaatatctccaactcggcattcccgattctgatggcgcgtaatgataaaaactactggctggcgtttggcgaaaaacgcgcctgggataaaaatgagctggcgtacattacggaagcgccttccattgtgcagccagagaatgttacgcgcgatactgcgactttcaacctgccgtttatttcgctggggcaagtcggtgaaggcaaactgatggttatcggtaacccgcactacaacagcatcctgcgttgcccgaacggttacagttggggcggtggtgttaatagtaaaggtgagtgtacgctcagcggtgattctgatgacatgaagcactttatgcagaacgtactgcgctacttgtcaaatgacatctggcagccaaataccaagagcatcatgactgtcggcaccaacctggagaacgtttatttcaaaaaagcgggccaggtattgggaaatagtgcaccatttgctttccatgaggatttcactggtatcacggttaaacagttgaccagctatggcgatctgaatccggaagagattccgttgctgatcctcaacggctttgaatatgtgactcagtggtctggcgatccctatgctgtgcctctgcgtgcagataccagcaaaccgaagctgactcagcaggatgtgaccgatctgatcgcttatctgaacaaaggtggctcggtgctgatcatggaaaacgtgatgagcaatcttaaggaagagagcgcgtccagttttgtgcgtctgctggatgccgcgggtctgtcaatggctctgaacaaatcggtggtgaacaacgatccgcaagggtatccggatcgcgttcgtcagcgtcgcgcgactggcatttgggtttatgaacgttatcctgctgcagacggcgcgcaaccgccgtacaccatcgacccaaatacaggggaagtgacctggaaataccagcaagacaacaagcctgatgacaagccgaaactggaagttgcgagctggcaggaggaagttgagggcaaacaggtaacgcgttatgcctttattgatgaagcggaatacacaacagaagaatctctggaagcggcaaaggcaaaaatctttgagaagtttcctgggttacaggagtgtaaggactcgacttaccattacgagattaactgtttggagcgccgcccaggcacggatgttccggtaacaggtggcatgtatgttccgcgctatacgcaactgaatcttgacgccgacaccgcgaaagcgatggtgcaggcggcggatttaggcaccaacattcagcgcctgtatcagcatgagctttatttccgtaccaaaggcagtaaaggtgagcgtctgaacagtgttgatctggaacgtctgtaccagaacatgtcggtctggctgtggaacgatacgaaatatcgttacgaagagggcaaggaagatgagctgggctttaaaacgttcaccgagttcctgaactgctacgccaatgatgcctatgcaggcggcaccaagtgctccgcagatctgaaaaaatcgctggtcgataacaacatgatctacggtgacggtagcagcaaagcgggcatgatgaacccaagctatccgctcaactatatggaaaaaccgctgacgcgtctgatgctgggccgttcctggtgggatctgaacattaaggttgatgtggagaagtacccaggatccgtatcggcaaagggtgagagcgttacggaaaacatcagcctgtactcgaatccgaccaaatggtttgcgggtaacatgcagtcaaccggcctgtgggcaccggcccagcaggacgtcaccattaagtcttcggcgtcagtcccagtgactgttaccgtggcgctggctgacgacctgactggacgtgagaagcatgaagttgcgctgaaccgtccgccaagagtgactaaaacgtatactctggaggctaacggtgaagtgaccttcaaggtgccttatggtggtctgatttatatcaagggcgacagtaaggatgatgtttctgctaacttcacctttaccggtgtagtaaaagcgccgttctataaagacggcgaatggaaaaacgatctggactcaccggcgccgctgggcgagctggagtctgcgtcgttcgtctataccacgccgaagaagaaccttgaggccagcaatttcactggtggtgtagcagaattcgctaaagatctggatacctttgccagctcgatgaatgacttctacggtcgtaatgatgaagacggtaagcaccggatgtttacctataaaaacttgacggggcacaagcatcgtttcaccaacgatgtgcagatctccatcggtgatgcgcactcgggttatccggtaatgaacagcagcttctcgacgaacagcaccacgctgccgacgacgccgctgaacgactggctgatttggcacgaagtcggtcataacgctgcagaaacaccgctgaacgtaccgggtgcaactgaagtggcgaacaacgtgctggcgctgtacatgcaggatcgctatctcggtaagatgaaccgtgtcgctgacgacattaccgtcgcgccggaatatctggacgagagcaacggtcaggcctgggcgcgcggcggtgcgggtgaccgtctgctgatgtacgcacagttgaaggagtgggcagaggaaaactttgatatcaaacagtggtatccagatggtgagctgcctaagttctacagcgatcgtaaagggatgaagggctggaacctgttccagttgatgcaccgtaaagcgcgcggcgatgatgttggtaacagcacctttggtggcaagaattactgtgctgaatccaatggtaacgctgccgacacgctgatgctgtgtgcatcctgggtcgctcaggcggatctttcggaattctttaagaaatggaatccgggtgcaagtgcttaccagttgccgggagcaacggagatgagtttccagggcggtgtgagctcttcggcttacagcacgctggcgtcactcaagctgccgaaaccggaaaaagggccggaaaccattaacaaggttaccgagcataagatgtctgccgag

The invention claimed is:

1. An immunogenic polypeptide comprising an amino acid sequence having at least 85% sequence identity to SEQ ID NO: 114, wherein the immunogenic polypeptide contains a deletion relative to the *E. coli* AcfD protein set forth as SEQ ID NO: 2-16 which increases solubility of the immunogenic polypeptide as compared to the full length protein and wherein the immunogenic polypeptide raises a substantially similar immune response in a subject as the *E. coli* AcfD protein, SEQ ID NO: 2-16 and wherein the deletion is removal of all of the N-terminal amino acids up to the gly-ser region and removal of all N terminal proline-rich repeat.

2. The immunogenic polypeptide of claim 1 wherein the immunogenic polypeptide is isolated, purified, or recombinant.

3. A composition comprising the immunogenic polypeptide of claim 1 with an adjuvant.

4. The method of raising an immune response in a mammal against intestinal or uropathogenic *E. coli* comprising administering to the mammal the polypeptide of claim 1.

5. The method of raising an immune response in a mammal against intestinal or uropathogenic *E. coli* comprising administering to the mammal the composition of claim 3.

* * * * *